United States Patent
Smith

(10) Patent No.: US 7,517,644 B1
(45) Date of Patent: Apr. 14, 2009

(54) METHOD AND COMPOSITIONS FOR CELLULAR REPROGRAMMING

(75) Inventor: Larry J. Smith, 1019 S. 106th Plz., Apartment # 104, Omaha, NE (US) 68114

(73) Assignee: Larry J. Smith, Omaha, NE (US)

( * ) Notice: Subject to any disclaimer, the term of this patent is extended or adjusted under 35 U.S.C. 154(b) by 0 days.

(21) Appl. No.: 08/472,801

(22) Filed: Jun. 7, 1995

Related U.S. Application Data

(63) Continuation-in-part of application No. 08/426,781, filed on Apr. 22, 1995, now abandoned, which is a continuation-in-part of application No. 07/748,997, filed on Aug. 23, 1991, now abandoned.

(51) Int. Cl.
*C07H 21/02* (2006.01)
*A61K 31/70* (2006.01)
*C12Q 1/68* (2006.01)

(52) U.S. Cl. .................. 435/6; 435/375; 435/377; 514/44; 536/23.1; 536/24.1; 536/24.5

(58) Field of Classification Search .................. 435/6; 536/24.1, 24.5; 514/44
See application file for complete search history.

(56) References Cited

OTHER PUBLICATIONS

Yuen et al, Clinical Studies of Antisense Therapy in Cancer, Jun. 2001, Frontiers in Bioscience, d588-593.*
Hawkins et al, Sys. Admin. of a Phosphorothioate Oligonucleotide with a Sequence Complementary to p53 for Acute Myelogenous Leukemia and Myelodysplastic Syndrome: Initial Results of a Phase I Trial, 1993, Antisense Research and Devel., vol. 3, pp. 383-390.*
Bishop et al, Phase I Trial of an Antisense Oligonucleotide OL(1)p53 in Hematologic Malignancies, Apr. 1996, Journal of Clinical Oncology, vol. 14, No. 4, pp. 1320-1326.*
CM Barton et al, Antisense Oligonucleotides directed against p53 have antiproliferative effects unrelated to effects on p53 expression, 1995, British Journal of Cancer, vol. 71, pp. 429-437.*
Sudhir Agrawal, Antisense Oligonucleotides: towards clinical trials, Oct. 1996, Tibtech, vol. 14, pp. 376-387.*

* cited by examiner

*Primary Examiner*—Sean McGarry
(74) *Attorney, Agent, or Firm*—Dann, Dorfman, Herrell & Skillman; Kathleen D. Rigaut

(57) ABSTRACT

The present invention provides methods and compositions useful in treating certain diseases herein termed "Aberrant Programming Diseases," including cancer and AIDS. According to one aspect of the invention, there is provided a method for treating an individual having an Aberrant Programming disease comprising administering to said individual an effective amount of a composition selected from the group consisting of an expression vector, a double stranded oligodeoxynucleotide, and an antisense oligodeoxynucleotide; said composition capable of regulating expression of a transcriptional regulator, said transcriptional regulator being expressed by the Aberrant Programming cells and further characterized by exhibiting a therapeutically useful change in said cell behavior in the Reprogramming Test. In a separate embodiment new antisense oligodeoxynucleotides are provided.

17 Claims, 3 Drawing Sheets

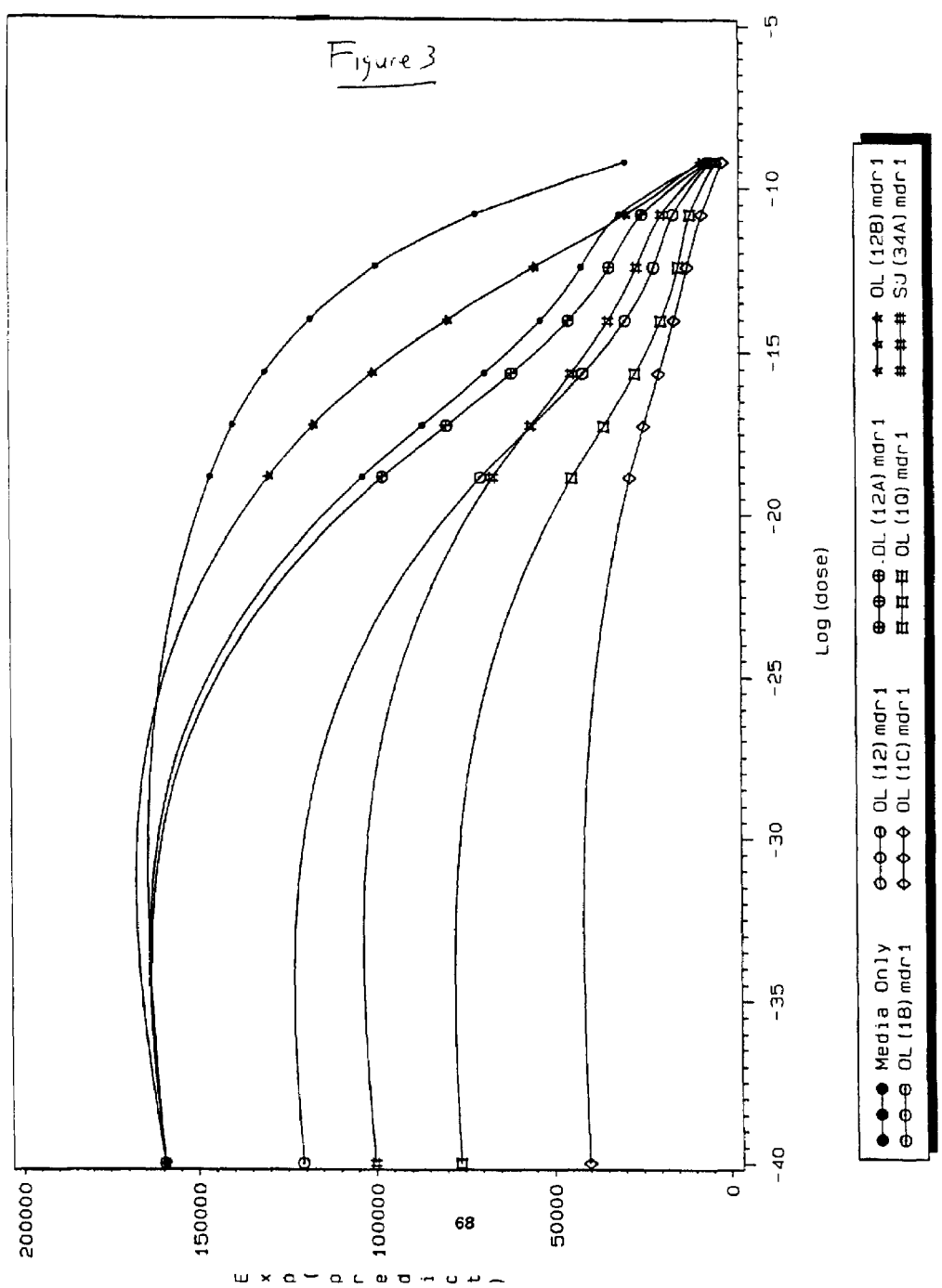

METHOD AND COMPOSITIONS FOR CELLULAR REPROGRAMMING

This is a Continuation-in-Part of application Ser. No. 08/426,781, filed 22 Apr. 1995, now abandoned which itself was filed as a Continuation-in-Part of application Ser. No. 07/748,997, filed 23 Aug. 1991 now abandoned.

BACKGROUND OF THE INVENTION

1. Field of the Invention

The present invention relates to methods and compositions useful in treating disorders in which the direct cause of the clinical disorder is the expression in the primary diseased cells of a differentiation program that does not normally exist. Such disorders are hereinafter referred to as Aberrant Programming (AP) Diseases. The invention also relates to method and compositions useful in therapeutically reprogramming normal cells.

As will be discussed more fully hereinafter, the AP diseases of this invention constitute a new disease classification and there is presented a novel molecular model of pathogenesis for these diseases. According to the molecular model of this invention, the basic disease causing entity in the AP diseases is a specific type of relational alteration among certain cellular components involved in program control. It is unlike any previously described molecular pathogenic mechanism. This model defines the nature of the therapy for these diseases, limits the potential set of therapeutically useful targets to a relatively small number of genes and leads to the unobvious conclusion that this includes the manipulation of certain "normal" genes is an appropriate approach for the treatment of AP diseases, thus, leading to a unique approach to therapy for the AP diseases of this invention. This model makes the selection of targets for proposed therapy straightforward and accessible to anyone skilled in the art. Also provided herein is a novel approach to diagnosing and developing prognostic criteria for the Aberrant Programming Diseases.

A preferred embodiment relates to the reprogramming of cell behavior through the manipulation of transcriptional regulators (TRs). The invention includes systemic treatment and compositions for such treatment, as well as in vitro manipulation of cells prior to transplantation of such cells with the host under treatment.

As will be discussed more fully hereinafter, a method is also disclosed for selecting target sites in the RNA transcripts of particular genes that individually have a high likelihood of being excellent target sites for the binding of antisense oligonucleotides which are intended to inhibit the expression of the corresponding gene. In a preferred embodiment, this target site selection method can be used to select antisense oligonucleotides for the treatment of Aberrant-Programming Diseases in accordance with the molecular model of Aberrant Programming Diseases disclosed herein. Taken together, this molecular model of Aberrant Programming Diseases (AP Model), which delimits the preferred gene targets for the development of the new therapies discussed herein for said diseases, and the method for selecting target sites within the transcripts of said genes, greatly simplifies the drug discovery process for the development of new treatment modalities and greatly increases the likelihood that clinically successful compounds will, thereby, be generated.

In yet another embodiment, the novel method disclosed herein for selecting antisense oligonucleotide target sites (and, thereby, the sequence of the corresponding antisense oligonucleotides) can be used with conventional rationale (independent of the AP model) by one with ordinary skill in the art to select therapeutic oligonucleotides for the treatment of a variety of diseases and medical purposes. The conventional rationale is, in essence, a rationale which links the known function(s) of particular molecules, in terms of their direct effects on specific cellular functions, with particular disease processes or therapeutic needs (as opposed to molecules such as TR that—non-obviously—may act indirectly as a result of being part of a combinatorial regulation mechanism).

2. Description of the Related Art

Very recent studies involving the use of antisense oligonucleotides for treatment of cancer have been reviewed by Stein and Cohen, Cancer Res. 48:2659 (1988). Several types of antisense molecules have been screened for their ability to inhibit the synthesis of particular proteins using both intact cells and in vitro systems for protein synthesis (See Ld. and Paoletti, Anti-Cancer Drug Design 2:325, 1988). For example, agents with specificity for RNA transcribed from the myc gene have been reported to inhibit the proliferation of the human AML line HL60 (Wickstrom, et al., Proc. Natl. Acad. Sci. USA 85:1028 (1988) and normal T lymphocytes (Heikkila, et al., Nature 328:445 (1987), and oligodeoxynucleotides complementary to cyclin mRNA have been reported to suppress the division of 3T3 cells (Jaskulski, et al. 1988).

More recently, it has been found that in the treatment of cancer with ODNs against myb, the proliferation of leukemic cells was inhibited with an accompanying lower degree of inhibition against normal cells. (Calabretta et al, PNAS, 88, 2351,1991.) Also, it has been shown that transient inhibition in a leukemia cell line resulted with an ODN against myc; however, unfortunately, a comparable inhibition against normal cells occurred (Zon et al patent). This patent also discloses inhibition of HIV replication using ODNs targeted to viral genes. Belenska et al (Science, 250, 997, 1990) have proposed the use of double stranded ODNs, binding to TR ligands as potential therapeutic agents for disease causing genes. They give blocking of NF-kB binding to HIV enhancer as an example. The use of retroviral vectors carrying antisense oncogenes for the treatment of cancer is known.

The fundamental problem with the foregoing part is that it is based on the notion that the expression of specific molecular abnormalities (altered regulation or mutation of endogenous genes or expression of exogenous genes) in the disease cells of these patients directly cause the clinical pathological features of the AP disease. It follows from such thinking that the therapeutic strategies should be directed to attacking these molecular abnormalities.

In the case of cancer, contemplated therapy involving antisense expression vector ODNs have been directed to oncogenes in accordance with the oncogene/anti-oncogene cancer model, or to growth factors expressed by cancer cells in accordance with the autocrine model. In the case of AIDS therapeutic strategies involving such agents being developed are directed toward blocking HIV expression and/or infection. There are no counterpart causal agents identified to the other AP diseases. Hence the therapeutic approaches under development are more empirical.

The present inventor first described in detail, in writing, in a confidential manuscript prepared for Gerald Zon, Ph.D. of Applied Biosystems Incorporated (now LYNX Therapeutics, Inc.) and completed in May of 1990, the concept of Aberrant Programming disease and the derivative notion of using antisense ODNs to modulate TR as a means of selectively reprogramming the cellular programs of the diseases cells/tissue in question. According to the AP disease model the fundamental pathology causing the clinical pathological features of these disorders is both relational and dynamic. In stark contrast to the prior art, the therapy of the present invention involves manipulation of patterns of TR expression. The invention provides an entirely new approach to the treatment of said selected diseases and provides a rational, empirical basis for the design of novel agents. The therapeutic reprogramming of normal tissue involving ODNs is unprecedented.

The Aberrant Programming model indicates that atherosclerosis is, for example, an Aberrant Programming Disease. In this case, atherosclerosis is said to result from a change in the pattern of expression of certain TR in the smooth muscle cells (SMC) associated with blood vessels; the changed pattern of expression of TR, then, is responsible for the particular differentiated state that characterizes atherosclerotic SMC and which, therefore, produces the disease. The conventional hypothesis that attempts to provide a molecular explanation for the pathogenic changes in atherosclerotic smooth muscle cells (SMC) is called the "monoclonal hypothesis" (Benditt and Benditt, Proc. Natl. Acad. Sci. USA 70: 1753, 1973). In essence, this hypothesis argues that atherosclerotic plaques are benign tumors that result from a mutagenic event in some key regulatory molecule, in a manner analogous to the conversion of a proto-oncogene to an oncogene in the case of malignant tumor cell development. In support of this "monoclonal hypothesis" it has been found that DNA isolated from cells recovered from atherosclerotic plaques is capable of transforming normal fibroblasts in a transfection-nude mouse assay, whereas DNA extracted from normal control endothelial cells does not induce such transformation. The gene(s) which are responsible for encoding this transforming capacity have not been identified, however. Ruled out so far are N-ras, K-ras, Ha-ras, erbA, erbB, fes, src, mos, Abl, sis, c-fos, c-myb and c-myc which have been shown to be expressed by SMC (Parkes et al., Am. J. Pathol. 138: 765, 1991). Thus, the "monoclonal hypothesis" requires the mutation of some key regulatory molecule as the causal factor in the development of atherosclerosis. It follows from the conventional rationale that this key regulatory molecule which is altered is the prime target for therapeutic intervention.

In contrast, the Aberrant Programming model argues that the basic molecular pathology in the atherosclerotic SMC is to be found in the pattern of TR expression, where the relevant TR are those involved in cellular program control. The Aberrant Programming model, therefore, identifies TR such as, for example, c-fos, c-myb and c-myc as being appropriate targets for evaluating potential therapeutic antisense ODNs for atherosclerosis in the Reprogramming Test (as defined hereinafter), even though these TR have not been found to be mutated in atherosclerotic SMC. If the molecular mutations that have been detected in the transfection-nude mouse assay contribute to the pathogenesis of atherosclerosis, they would be considered by the AP model to be "risk factors". Risk factors in this context are defined as determinants that increase the probability that the afflicted cells/tissue will express an altered pattern of TR, thereby facilitating the generation of an Aberrant differentiation program. The AP model sets the foundation for a novel therapeutic strategy. The model predicts, for example, that there are antisense ODNs which, when targeted to certain TR, will produce a therapeutic reprogramming of atherosclerotic SMC (such as, for example, reversing the Aberrant cellular differentiation program to a more normal state, or, inducing apoptosis in the atherosclerotic SMC); the AP model also predicts that such effects will not be seen when the antisense ODN is used to treat a wide variety of other normal and diseased cell types that express different differentiation programs, even though they express the same TR target and the expression of said TR may be down regulated by the antisense ODN treatment. The basis of this logic can best be understood by making an analogy to "language", as is done in Table I.

Rosenberg and his colleagues, using a rat model system, explored the potential use 30 of c-myb antisense ODNs for the treatment of restenosis. Restenosis refers to the re-occlusion of atherosclerotic blood vessels following a medical procedure to reverse the obstruction to blood flow produced by atherosclerotic plaques (Simons and Rosenberg, Circulation Res 70: 835, 1992; and, Simons et al., Nature 359: 67, 1992) (United States Patent Application #723454, 28 Jun. 1991; United States Patent Application #792146, 08 Nov. 1991; United States Patent Application #855416, 18 Mar. 1992). The second of the published studies demonstrates that the local delivery of phosphorothioate ODNs to rat carotid arterial SMC in vivo results in a substantial uptake of the ODNs by the SMC and a prolonged retention of these compounds by the SMC. These investigators showed that c-myb antisense ODN, but not the corresponding sense ODN, inhibited the proliferation of SMC in the aorta of normal animals following regional damage to the vessel wall resulting from balloon angioplasty. Balloon angioplasty damages the endothelium underlying the region of treatment and causes intimal migration and proliferation of the SMC over the length of the damaged blood vessel. The result of treating the damaged vessels with the c-myb antisense ODN was a substantial improvement in the patency of the affected vessel after the induced trauma, compared to control animals not treated with the c-myb antisense ODN. The c-myb antisense ODN used to treat the normal smooth muscle cells either in vitro or in vivo, however, had four guanine bases in a row which could cause the formation of a "G-quartet", while the control ODN did not. The suppression of SMC growth, therefore, may not have been due to an antisense effect on c-myb, but rather from a non-antisense effect, with the reduction in c-myb expression in the SMC being a secondary event. This possibility was not apparently explored by these investigators.

Three groups have examined the possibility that c-myc antisense ODNs might be useful for the treatment of restenosis. Zalewski and his colleagues were the first to carry out these studies (Shi et al., Circulation 88: 1190, 1992; and Shi et al., Circulation 90: 944, 1994) (United States Patent Application #4799, published 7 Jan. 1993). The first of the Zalewski papers examined the usefulness of c-myc antisense ODNs for inhibiting the proliferation of normal human SMC. The c-myc antisense ODN was shown to inhibit the proliferation of the SMC while the corresponding sense ODN and a mismatched control ODN did not. The published in vivo work by Shi et al. (1994) again demonstrated that phosphorothioate ODNs can be readily delivered to SMC in the coronary vessels of animals where the ODNs are taken up in sufficient quantities to produce biological effects. Specifically, coronary blood vessels of pigs were damaged by balloon angioplasty. The human c-myc antisense ODN or the corresponding sense control ODN, were then applied to the damaged vessels. It was not reported, however, whether or not the human c-myc antisense ODN was sufficiently complementary to the c-myc transcript of the pig to permit effective binding of the human ODN sequence to the pig target transcripts. The c-myc, but not the control ODN, substantially inhibited the proliferation of SMC, resulting in improved blood flow through the affected vessels, compared to control animals not treated with the c-myc antisense ODN. Again, however, the antisense ODN used in the in vivo efficacy studies had four guanine bases in a row, while the control ODN did not. This four-guanine sequence could explain the capacity of the "therapeutic" ODN to inhibit the proliferation of the pig SMC and to inhibit the c-myc expression, while the "control" ODN did not. Bennett et al. (J. Clin. Invest. 93: 820, 1994) and Biro et al. (Proc. Natl. Acad. Sci. USA 90: 654, 1993), using the same c-myc antisense ODNs and control ODNS, demonstrated an inhibition of rat SMC proliferation in vitro.

Hence, the published studies of the use of c-myb or c-myc antisense ODNs to block experimentally-induced restenosis in animal models could be interpreted as showing that proliferation of cells (in this case, normal smooth muscle cells) can be blocked simply by exposure to compounds which have a non-specific capacity to inhibit proliferation (such as, for example, by non-specific masking of cell surface receptors, or by interference in essential metabolic pathways). Hence, these findings do not constitute "cellular reprogramming" for the purposes of achieving a therapeutic effect as defined herein. A "true reprogramming event" that involves inhibition of proliferation in accordance with the rationale provided herein would show a dependence on the differentiation status of the target cells; i.e., the reprogramming event (initiated by the antisense ODNs) must only work on cells that exhibit a particular set of differentiation programs, and not work on cells which exhibit a different set of differentiation programs. For example, an antisense ODN capable of blocking SMC proliferation by a reprogramming effect would not be able to block the proliferation of human cells in general. The possibility remains, however, that antisense ODNs directed to c-myc or c-myb could cause a therapeutic reprogramming of atherosclerotic SMC, in accordance with the present invention. This possibility remains because the appropriate experiments have not yet been done.

The design of antisense oligonucleotides for the inhibition of gene expression has been based primarily on one or the other (or both) of two considerations. First, investigators have targeted antisense oligonucleotides to regions of RNA transcripts known to be involved in the control of pre-mRNA processing or mRNA translation, such as splice sites or the start codon (AUG), respectively. Second, investigators have used computer models of the secondary structure of mRNA to "visualize" mRNA regions that might be susceptible to ODN targeting; these structural modeling procedures are not, however, highly predictive of the actual secondary structure of the mRNA in situ. Design of antisense ODNs according to novel methods disclosed in the present invention, however, is not dependent on either of these approaches to antisense ODN design. Rather, disclosed. herein is a novel computer-based method for selecting unique "hotspots" in RNA transcripts that are particularly well suited for targeting antisense oligonucleotides for the purpose of inhibiting the expression of genes and thereby greatly enhancing the likelihood of producing therapeutic effects. The method herein described appears to be an unexpected and substantial improvement over the two conventional approaches to selecting target sites for antisense oligonucleotides.

There are now many examples of the successful use of antisense ODNs to selectively block the expression of any of a wide variety of gene targets, both in in vivo and in in vitro studies. For example, in in vivo model systems: inhibition of Human Immunodeficiency Virus (HIV) gene expression (including tax gene) in human cells grown as xenogeneic transplants in animal models (Kitajima et al., J. Biol. Chem. 267: 25881, 1992);targeting genes in xenotransplanted human cancer cells in animal models, including targeting c-myc, c-Ha-ras, NF-KB, c-myb, c-kit and bcr-Abl (Agrawal et al., Proc. Natl. Acad. Sci. USA 86: 7790, 1989; Agrawal et al., Proc. Natl. Acad. Sci. USA 88: 7595, 1991; Biro et al., Proc. Natl. Acad. Sci. USA 90: 654, 1993; Gray et al., Cancer Res. 53: 577, 1993; Higgins et al., Proc. Natl. Acad. Sci. 90: 9901, 1993; Ratajczak et al., Proc. Natl. Acad. Sci. USA 89: 11823, 1992; Wickstrom et al., Cancer Res. 52: 6741, 1992; Skorski et al., Proc. Natl. Acad. Sci. USA 91: 4504, 1994). In each of these instances involving the administration of antisense ODNs to treat animals with xenogeneic human cancers, the transplanted malignant cells were found to regress.

A number of difficulties, however, have also been reported in the use of antisense ODNs in in vitro studies, none of which have proven to be insurmountable, however, in view of the existing art and technology. In general, problems in the in vitro use of antisense ODNs (most commonly phosphorothioates) have centered around what has been viewed as "poor uptake" and/or the production of unintended biologic effects; i.e., non-antisense effects. These unintended effects fall into two major categories: first, there are biologic effects that are attributable to the backbone structure of the oligonucleotides; and, second, there are sequence-specific non-antisense (aptameric) effects that appear to be dependent upon the three-dimensional conformation of the ODN in solution, and, consequently, on the positioning of the molecular electrostatic (ionic) charges associated with the ODN molecule. Like ODN antisense effects, both of these non-antisense effects are dose dependent.

There are large differences in the capacity of similar ODNs directed to transcripts of a given gene to block the expression of that gene in cells; the reasons appear to be related to variations in the availability of the particular target site on the transcript complementary to the antisense ODN. No method has previously been described which permits antisense ODNs to be designed so that, with a high probability, some will exhibit optimal activity in the purpose intended. Hence, what has been referred to as the "poor uptake" of ODNs by some cell types in vitro may in large part reflect the use of antisense ODNs that are not properly designed and are, therefore, not optimally potent. It is also possible that the culturing of cell lines under atmospheric oxygen conditions (which is the usual and common in vitro practice) produces a situation in which antisense ODNs are made less active than they may be at much reduced (and more physiologically-relevant) oxygen tensions (Smith L J and Kay H D. Unpublished observations). The basis of this latter phenomenon could be due, at least in part, to the increased generation of reactive free oxygen radicals under ambient (atmospheric) oxygen levels by cells following treatment with any of several types of ODNs, such as phosphorothioates. Highly-reactive free oxygen radicals have been shown to have the capacity to alter the lipids in the surface membranes of cells, and to activate certain second-messenger pathways. Such alterations could lead to an inhibition of antisense ODN uptake and/or to other non-antisense ODN-dependent biologic effects.

A complete blockade of the induction of free radical formation by cells in response to exposure to ODNs at physiologic oxygen levels would require the presence of potent anti-oxidants such as, for example, vitamin C or vitamin E. Finally, in general, it appears that antisense ODNs are more active when used on freshly-obtained patient specimens than they are when used on established cell lines, either in vitro or in vivo. Furthermore, at least some established cell lines appear to be more responsive to antisense ODNs when studied in vivo in animal models than when studied in vitro in cell cultures. Dean and McKay (Proc Natl Acad Sci USA 91: 11762, 1994), for example, found that an antisense ODN directed to $PKC_a$ could inhibit the growth of the C127 murine mammary epithelial cell line both in vitro and in vivo. To get enough ODN into the cells grown in vitro to reduce $PKC_a$ expression and inhibit growth, cationic liposomes had to be utilized. The naked antisense ODN, however, worked very well when injected into mice carrying the C127 cell line as a transplant. Again, this greatly-superior in vivo response is consistent with the concept that the ODNs cause a much lower level of free radical production in the animal.

Similarly, the apparent unintended backbone-dependent biologic effects of antisense phosphorothioate ODNs on treated cells can be eliminated (or adequately reduced) by the use of more appropriately designed (and, therefore, more efficacious) antisense ODNs. These unintended biologic effects, of which the inhibition of cell proliferation is most common, generally only occur at phosphorothioate concentrations of 5-10 micromolar ($\mu M$) or greater in the final culture medium. The better designed and more potent antisense ODNs, however, are biologically most active at least 10-fold lower concentrations, particularly when fresh tissue is used, or when the antisense ODN is used in vivo.

Pronounced aptameric effects usually appear to be the property of only a small proportion of ODN. Aptameric effects result when an ODN binds tightly and specifically to a particular biomolecule, and, as a result, modifies the biological function/behavior of said biomolecule. Aptameric effects are dependent on the nucleotide sequence in the ODN. Presumably, the sequence dependence of these effects reflects the fact that ODNs with different nucleotide sequences assume different spacial conformations, dictated by neighboring nucleotide-nucleotide interactions. The nature of the backbone chemistry, however, is also relevant in aptameric effects since said chemistry (and associated molecular electrostatic [ionic] charges) also influences the overall spacial conformation which the ODN molecule can assume in solution. Only a subset of the possible aptameric effects which an ODN might produce, however, would be expected to be an absolute counter-indication for therapeutic use as an antisense compound. Any such undesirable effects can be overcome by simply choosing another antisense ODN directed to the same target transcript, but which contains a different nucleotide base sequence, or, in some instances, by changing the ODN backbone. The former option may involve selecting an entirely different "hotspot" on the transcript, or simply making modest changes (length, position) in the ODN in question. Changes in ODN secondary structure may also be achieved by making a small number of base substitutions, such as with inosine, that do not interfere significantly with binding of the ODN to the target RNA transcript.

In contrast, some antisense ODNs may possess aptameric-like effects that enhance their therapeutic efficacy. The present inventor, for example, has found that some antisense ODNs (in particular, phosphorothioate ODNs) which target MDR1 gene transcripts (and thereby inhibit P-glycoprotein expression) apparently can also reduce MDR1 mRNA levels by an aptameric-like effect that presumably involves the inhibition of second messenger pathways such as the protein kinase-C and/or protein kinase A pathways.

Many of the in vitro successes in the application of antisense ODNs for therapeutic purposes have been readily extrapolated to in vivo use. This is evidenced by the numerous publications showing the in vivo efficacy of antisense ODNs. Furthermore, several ODNs have already been approved by the United States Food and Drug Administration for clinical testing. It should be noted that the ODN uptake problems sometimes encountered in in vitro studies have not been reported to be problematic in in vivo studies. Pharmacologic/toxicologic studies of phosphorothioate antisense ODNs have shown that phosphorothioates are adequately stable under in vivo conditions, and that they are readily taken up by all the tissues in the body following systemic administration (Iversen P I, Anticancer Drug Design 6:531, 1991; Antisense Res Develop 4:43, 1994; Crooke, Ann Rev Pharm Toxicol 32: 329,1992; Cornish et al., Pharmacol Comm 3: 239,1993; Agrawal et al., Proc Natl Acad Sci USA 88: 7595, 1991; Cossum et al., J. Pharm. Exp. Therapeutics 269: 89, 1994). In addition, these compounds readily gain access to the tissue in the central nervous system following injection into the cerebral spinal fluid (Osen-Sand et al., Nature 364: 445,1993; Suzuki et al., Amer J. Physiol. 266: R1418,1994; Draguno et al., Neuroreport 5: 305, 1993; Sommer et al., Neuroreport 5: 277, 1993; Heilig et al., Eur. J. Pharm. 236: 339, 1993; Chiasson et al., Eur J. Pharm. 227: 451, 1992). Phosphorothioates per se have been found to be relatively non-toxic, although a few particular ODNs have produced unintended toxic effects in animals. The latter instances of toxicity seem to be attributable to an unexpected aptameric effect on the part of the ODN in question.

In summary, it appears that antisense ODNs have the essential properties which make them useful as therapeutic agents, both in vivo and in vitro. In vitro antisense activities now can reasonably be expected to be seen in vivo. Two major areas needed for further development of antisense ODNs as therapeutic agents involve (a) the choice of gene targets for diseases like cancer and atherosclerosis, Alzheimer's and schizophrenia, and (b) methods for the selection of optimally active antisense ODNs directed to a particular gene target. These needs are addressed by the novel inventions herein described in the present invention.

SUMMARY OF THE INVENTION

In accordance with this invention, there is provided a method for reprogramming cell behavior to achieve therapeutic effects through manipulating patterns of TR expression. Also provided is a method for treating an individual having an AP disease comprising administering to said individual an effective amount of a composition selected from the group consisting of an expression vector, a double stranded ODN, and an antisense ODN. Said composition must be capable of regulating expression of a TR. Said TR is expressed by the AP cells and further characterized by the fact that it exhibits a therapeutically useful change in said cell behavior in the Reprogramming Test of this invention (hereinafter more fully described). It is noted that when the AP disease is AIDS, said TR is not encoded by HIV. In the case of cancer, said TR is a Traitor Gene of this invention (more fully discussed hereinafter) and, preferably, excludes oncogenes, e.g. fos, myc, myb, rel, jun (in an altered form).

Another embodiment of this invention is a method for treating an individual having a clinical disorder comprising administering to said individual an effective amount of a composition selected from the group consisting of a double stranded ODN and an antisense ODN. The composition is capable of regulating expression of a TR. The TR is expressed by therapeutically relevant cells and is further characterized by exhibition of a therapeutically useful change in said cell behavior in the Reprogramming Test of this invention.

The invention revealed here primarily embodies a new type of therapy based on reprogramming cellular behavior. Collateral inventions, however, also follow including: (1) the diagnosis and/or staging of aberrant programming diseases by assaying for the expression of particular transcriptional regulators and their variants in diseased cells; and, (2) for any given aberrant program disease, the use of test agents in vitro for determining the optimum agent(s) for treating any particular patient.

Thus, there is provided a method for diagnosing or staging an AP disease comprising identifying the relevant subset of TRs expressed by AP cells from an AP patient. A method for selecting the most efficacious treatment regimen for an AP disease forms another embodiment. This embodiment comprises identifying the relevant subset of TRs expressed by AP cells from an AP patient. These embodiments are described more fully hereinafter.

In addition, the invention provides a method for treating therapeutically relevant cells from an individual having a clinical disorder prior to transplantation of the cells back into the individual (autologous transplant) embodiment. This embodiment comprises the steps of:

a) obtaining therapeutically relevant cells from the individual and b) exposing the therapeutically relevant cells to a reprogramming amount of an ODN having a sequence complementary to a sequence of RNA transcribed from a TR regulated gene or double stranded ODN ligand of a transcriptional regulator present in the TR cells. In a preferred embodiment the cells are taken from prenatal tissue or from a different donor than the individual under treatment (allogeneic transplant).

Selection of the most efficacious treatment regimen for an AP disease forms another embodiment of this invention. This method involves removing and culturing AP disease cells from an AP disease patient with an antisense ODN specific to a TR from the relevant subset of TRs expressed by AP cells from an AP patient or a double stranded ODN to the DNA binding domain of such TR to determine optimal treatment.

In carrying out the methods of treating AP diseases of this invention it is critical to select the proper targets. Hence, an important embodiment of this invention is a method for the selection of a target for the treatment of an AP disease comprising (i) determining the subset of transcriptional regulators and their direct modifiers expressed by the aberrantly programmed tissue, the corresponding normal tissue, or the constitutively self-renewing normal tissue or, alternatively, making a similar determination for any other normal tissue that is to be therapeutically manipulated in accordance with this invention; (ii) adding or subtracting expression of transcriptional regulator(s), or their direct modifiers, from cells to be therapeutically reprogrammed and the appropriate control tissue; (iii) scoring effect on cellular programming and selecting potential therapeutic agents according to the Reprogramming Test; (iv) testing effect of addition or subtraction of the function of particular transcriptional regulators, using the agents selected, (in an animal model system if the therapeutic agents are for systemic use), and (v) reducing or eliminating any undesirable side effects that might be produced by the potential therapeutic agents. This embodiment is described in detail hereinafter.

Exploiting specific cell type differences in target RNA for selecting differentially available sites for ODN binding forms another embodiment of this invention. This embodiment comprises a method for cell type dependant targeting of specific RNA transcripts comprising selecting an ODN capable of binding to and leading to the destruction of said RNA in the tissue to be therapeutically manipulated, but not in tissue where side effects are produced by destruction of said RNA. Exemplary is the use of an antisense ODN directed to cyclooxygenase RNA that selectively binds to and destroys said RNA in hematopoietic tissue while avoiding said RNA in gastrointestinal tissue.

All of the foregoing embodiments involve reprogramming of cell behavior to achieve therapeutic effects through manipulating patterns of TR expression.

Yet another embodiment of this invention is a novel computer-based method for selecting "hotspots" in the transcripts of particular genes, which hotspots define the possible sequences that the corresponding antisense ODNs can take. These hotspots include the binding sites for the most highly active of the possible antisense ODNs as judged by their capacity to suppress the expression of the corresponding gene. This computer method, based on the commercially-available "OLIGO" program created by Dr. Wojciech Rychlik (Rychlik and Rhoads, Nucleic Acids Res. 17: 8543, 1989; copyrighted 1989) utilizes parameters intuitively chosen by the inventor to direct the "OLIGO" computer program in the selection of antisense ODNs that have a high probability of being highly active. In this novel approach, the two criteria conventionally used to select antisense ODNs (RNA secondary structure and biologically functional domains within RNA transcripts) are ignored. The criteria for ODN selection used in the novel method described herein relate to the base-sequence-dictated physical properties of the prototype or test antisense ODNs, the nucleotide base sequence of which is determined by the nucleotide sequence of the "hotspot" region of a particular gene being evaluated.

When applied to the analysis of transcripts of TRs or their direct modifiers, this novel computer-based method can be used to select the most highly active therapeutic antisense ODNs for the treatment of Aberrant Programming Diseases in accordance with the Aberrant Programming Disease model disclosed herein, or for the therapeutic reprogramming of normal cellular functions. In addition, antisense ODNs designed by the novel computer-based method disclosed can be used to block the expression of genes known to be directly implicated in a variety of disease processes or which are known to be directly involved in biologic functions of therapeutic importance. ("Direct" involvement of a particular molecule in this context is to be contrasted with the direct involvement of patterns of expression of particular regulatory molecules [as part of a combinatorial regulation system that controls the cellular differentiation program and subprograms such as proliferation and apoptosis], as considered by the Aberrant Programming model in cellular reprogramming). These direct cause-and-effect associations between particular molecules or groups of molecules and particular disease or other biologic processes make the choice of possible target gene for therapeutic antisense ODN inhibition obvious to one with ordinary skill in the art. As examples: (1) β-amyloid precursor and apolipoprotein E are implicated in the pathogenesis of Alzheimer's Disease. They are, therefore, obvious antisense targets, as are (2) vascular endothelial growth factor (VEGF) which is implicated in cancer and in Rheumatoid Arthritis; (3) cyclooxygenase which is involved in pathologic inflammatory conditions such as Arthritis; and (4) the expression of molecules known to be directly involved in the regulation of apoptosis, such as the variants of bax, bcl-2, and bcl-x, which can be blocked by antisense ODNs for the purposes of promoting or inhibiting apoptosis in accordance with the therapeutic needs of the situation. It would be desirable to block apoptosis, for example, following ischemic damage resulting from the occlusion of blood vessels leading to an organ such as the heart or brain. Conversely, it would be desirable to Dromote apoptosis in malignant or atherosclerotic-programmed cells. Associations between particular target genes and disease processes are shown in Table X.

Table XI lists some of the gene/proteins other than transcriptional regulators that have been implicated in the control of apoptosis or programmed cell death. Select antisense ODNs directed to these targets should be therapeutically useful for the treatment of the diseases/conditions listed in Table XII, which lists some of the diseases/processes in which apoptosis (or programmed cell death) appears to play a key role.

The antisense ODNs targeted to TR or their direct modulators selected by the criteria disclosed herein can find uses beyond the treatment of the Aberrant Programming Diseases in accordance with the Aberrant Programming model. For example:

(1) TR involved in the control of cellular programming also can function to control the expression of particular genes such as telomerase and β-amyloid precursor protein which are implicated in the production of certain disease processes (Sp-1, Ap-1 and Ap-4, for example, are among the TR known to regulate β-amyloid precursor protein expression; and certain Hox genes are likely to be involved in the control of telomerase expression). Hence, blocking the expression of TR required for the expression of these medically important molecules can find therapeutic use. Other TR not involved in the regulation of cellular programs are restricted in their function to controlling the expression of particular genes associated with a particular state of cellular differentiation, or controlling the expression of housekeeping genes. These latter genes can be of clinical importance, and antisense ODNs which inhibit expression of TR involved in promoting or controlling the disease process may produce a desirable therapeutic effect. Examples of such TR include Ref-1, and, possibly, members of the GADD family of TR.

(2) TR encoded by the host cell are known to be important for the expression and functioning of infecting viruses. Indeed, blocking the action of NF-Kβ in HIV-infected cells by ODNs have been shown to reduce HIV expression. Examples of virally-induced diseases that would benefit from such treatment include, but are not to be limited to, those caused by HIV, HTLV, CMV, Herpes simplex, measles viruses, the hepatitis virus variants, rhinoviruses, influenza viruses and hemorrhagic fever viruses. Host-encoded transcriptional regulators that are known to regulate the following types of virus are given as examples:

HIV: USF, Elf-1, Ap-1, Ap-2, Ap-4, Sp-1, Sp-3, Sp-4, p53, NF-kβ, rel, GATA-3, UBP-1, EBP-P;

CMV: SRF, NF-kβ, p53, Ap-1, IE-2, C/EBP;

Herpesviruses: USF, Spi-1, Spi-B, ATF, CREB and C/EBP families, E2F, YY-1, Oct-1, Ap-1, Ap-2, c-myb, NF-kβ;

Hepatitis viruses: NF-1, Ap-1, Sp-1, RFX-1, RFX-2, RFX-3, NF-kβ, Ap-2, C/EBP.

(3) Arguably, TR—particularly those involved in the control of cellular programming—also regulate higher-order functioning in the nervous system. Antisense ODNs directed to c-fos, for example, have been shown to alter neurological functioning in animal models (Dragunow et al., Neuroreport. 5: 305, 1993). According to the present invention, altered patterns of TR expression in nerve cells can result in Aberrant Programming of the nerve cells, resulting in certain mental disorders such as schizophrenia. Hence, antisense ODNs, selected using the method described herein are expected to be of use for such diverse medical needs as the treatment of psychoses, depression and epilepsy.

Table X provides a general overview of some of the diseases in which the gene targets presented herein have been implicated. All of the transcriptional regulators (and their direct modifiers) known to be involved in the regulation of cellular differentiation, proliferation and/or apoptosis cellular programs (or "Programmed Cell-Death") are candidates for the preferred embodiment which is the treatment of Aberrant Programming Diseases in accordance with the Aberrant Programming model. Particular subsets of these TR that are appropriate targets for developing antisense therapeutics for a particular disease are delimited by determining which of these TR are expressed by the diseased cells in question.

Hotspots and prototype ODNs are also provided for certain transcriptional regulators that have not yet been implicated in the control of these cellular programs. This association, or lack thereof, can be established by anyone with ordinary skill in the art, using established methods. The appropriate disease applications of antisense ODNs directed to the other gene targets for which "hotspots" and prototype antisense ODNs have been provided herein are related on the usual cause-and-effect basis discussed elsewhere herein.

It follows from the AP model that there is not simply just one possible "therapeutic solution" when one is confronted with developing an antisense ODN therapeutic to treat 30 AP diseases in accordance with the present invention. That is, several different antisense ODNs—directed against different members of a select set of TR gene targets—may be active in treating the same disease. This situation is a direct consequence of the facts that (a) the TR involved in cellular programming are acting in an interdependent way as part of a combinatorial regulation system, and that (b) different TR combinations can direct the same change in cellular programming. In the analogy given between the AP cellular programming model and the grammatical rules of the English language (see Table I), the latter phenomenon is referred to as "synonyms".

Thus, as a consequence of the nature of the AP diseases and as a consequence of the nature of the non-antisense ODN effects on cells, it will not be possible a priori to determine on purely theoretical grounds which particular antisense ODNs will be useful for the treatment of any given AP disease. The major advantage of the present invention over the prior art is that it makes the fundamental nature of the AP diseases comprehensible, and, thereby, allows the most rational approach possible to be applied to the treatment of these diseases. This rational approach which is laid out here is an enormous improvement over the prior art in that—in combination with the methods described herein for selecting antisense ODNs—it makes it possible to have a rapid advance in the development of therapy for diseases that have been almost totally intractable using the existing art.

FIG. 3 is a graph showing the effects of different MDR oligonucleotides on thymine incorporation into 8226/Dox4 cells.

DESCRIPTION OF THE PREFERRED EMBODIMENTS

AP Disease Model and List

Figure 1:
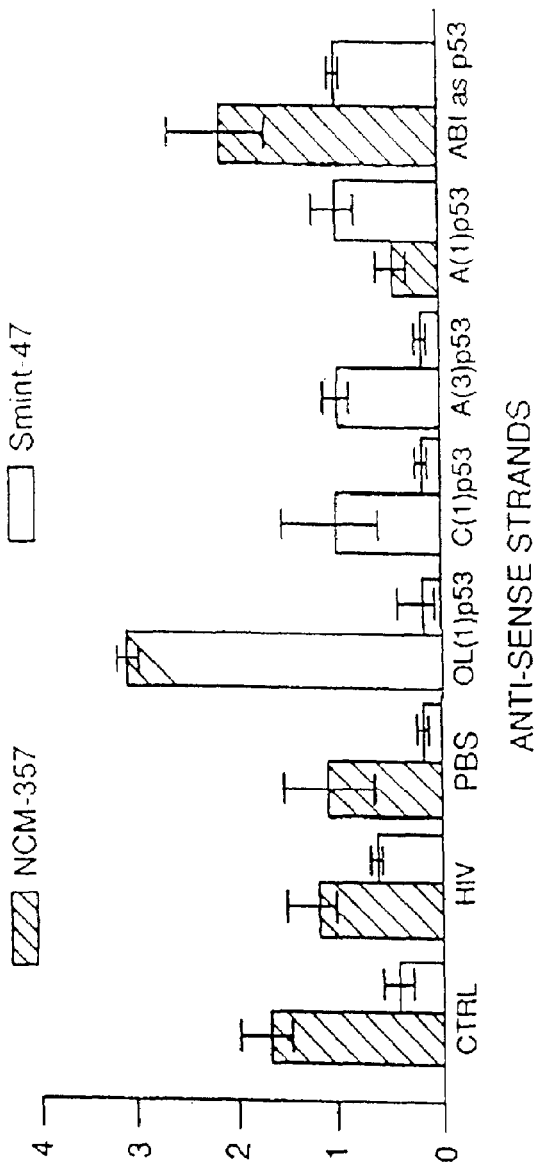
FIG. 1 is a graph showing the effects of antisense oligonucleotides on incorporation of thymidine into DNA in G1 cells.

Definition of a "cellular program"
The coordinated appearance in cells of a cell type restricted pattern of gene expression over time that provides for a particular phenotype and as a result for the determination of the range of possible cellular responses to exogenous stimuli.

The fundamental program can be thought of as a differentiation program which in turn controls the subprogram responses of the cell to environmental and other exogenous cues where the subprograms include cellular viability (apoptosis) and proliferation.

Definition of an "Aberrant Programming Disease"

One in which the direct cause of the clinical disorder is the expression in the primary diseased cells of a differentiation program that does not normally exist. That is, there is an expression of normal genes that provide for particular differentiated phenotype in abnormal combinations. The result is that these diseased cells become capable of expressing pathogenic behaviors involving cellular differentiation, viability and proliferation. These attributes of the primary diseased cells can also induce pathologic change, in their tissue environment.

The term "direct cause" with respect to pathogenesis is to be distinguished from "risk factors." Typically an AP Disease will be associated with numerous risk factors that in various combinations appear to "cause" the appearance of the disease. In fact, however, they cause the changes in the pattern of transcription regulator (TR) expression and chromatin domain availability which in turn causes the disease. This is important because programs can evolve and can become independent of any risk factors involved in their induction. Risk factors include mutagenic events, viruses, chromosomal abnormalities, genetic inheritance, and diet.

Aberrant programming disorders can be manifested as either a hyperplastic or a hypoplastic (degenerative) disease or a combination of both.

Examples of diseases where the aberrant program phenotype is expressed:
Cancer
Myeloproliferative Diseases
polycythemia vera
agnogenic myeloid metaplasia
essential thrombocytosis
Myelodysplasias
refractory anemia
refractory anemia with ringed sideroblasts
refractory anemia with excess blasts
refractory anemia with excess blasts in transition
Atherosclerosis
AIDS-related complex
AIDS
Alzheimer's Disease
Autoimmune Diseases, including:
inflammatory bowel diseases
multiple sclerosis
Rheumatoid arthritis
Systemic lupus erythematosus
Schizophrenia Molecular Model According to the molecular model set forth herein, the basic disease causing entity in the AP diseases is a specific type of relational alteration among certain cellular components involved in program control. It is unlike any previously described molecular pathogenic mechanism. This model defines the nature of a novel therapy for these diseases, limits the potential set of therapeutically useful targets to a relatively small number of genes and leads to the unobvious conclusion that the manipulation of certain "normal" genes is an appropriate approach for the treatment of AP diseases, in this way the model makes the reduction to practice of the proposed therapy straightforward and accessible to anyone skilled in the art.

Specifically, the essential molecular pathology in the AP diseases consists of changes in the interdependent patterns of TR expression and/or chromatin domain availability for transcription. In turn, these relational alterations provide for the expression of abnormal cellular programs involving cellular differentiation which are pathogenic. Particular TR or certain molecules involved with the control of domain status may be structurally abnormal. However, these are not necessarily useful targets for therapeutic intervention.

Tenets of the model relevant to the development of specific therapy:

A) Those true of both normal and aberrant programming:
1) The pattern of domain availability determines the possible range of genes that can be expressed in the cell and, therefore, limits the range of cellular programs that can be expressed.
2) The pattern of TR expression is the molecular equivalent of a programming code. By analogy with language particular combinations of TR (letters) working as a unit (words) regulate the expression of sets of genes in a coordinate fashion while the complete set of TR combinations used in any given cell (sentence) determines which of the possible phenotypes the cell will expressed, and therefore the overall character of the cell's differentiation program (see Table I for more details where cancer is used as an example).
3) Only a subset of the total number of TRs involved in the control of cellular differentiation for the total organism are expressed in any given cell type and they are few in number.
4) Similar effects on particular patterns of gene expression (programming) can be achieved by more than one specific combination of TR (synonyms).
5) The specific functional consequences of a particular TR's being expressed is context-dependent. That is, its effects on cellular programming depends both on which other TR it combines to regulate a particular set of genes (what words it appears in) and on the total set of different TR combination expressed by the cell (the sentence).

B) True of AP cells but not normal cells:
1) The combinations of TR seen in AP cells is different from that seen in any normal cell (the sentence is not expressed by any normal cell).
2) The specific functional consequences of any given particular TR being expressed in an AP cell, therefore, will be different from the consequences seen in a normal cell.
3) AP cells, therefore, express a cellular differentiation program that is different from any normal differentiation program. As a result AP cells express pathogenic behaviors resulting from their altered differentiation, viability and proliferation characteristics.
4) Hence, equivalent manipulations of the expression of a given TR in normal cells vs. aberrantly programmed cells can produce differential effects on cellular behavior. This can form the basis of therapeutic intervention.
5) The subset of TRs expressed by any AP cell is expected to include TR not expressed by the corresponding normal cells and/or conversely. These TRs within the AP cells will be normal TRs ectopically expressed or modified (alternate splicing promoter use or post-translational modification) or mutated to a TR with altered binding properties.

It follows from the rationale given herein that—for any given AP disease made up of disease variants that contain AP cells that have distinctive phenotypes of pathological significance—that these distinct phenotypes will have correspondingly variant patterns of TR expression. In cancer, for example, malignant cells with a multidrug-resistant phenotype would be expected to have a somewhat different pattern of TR expression than drug sensitive malignant cells. However, these variant phenotypes, such as multidrug resistance, should be considered as being an instance of AP cells expressing a subprogram of the greater malignancy program that produces cancer. It should be possible, therefore, to select and target ODNs separately to the malignancy program or to the multidrug resistance subprogram, for example, by attacking different TRs; or to select ODNs which would simultaneously effect both the cancer per se and the subprogram (which, in this example, is multidrug resistance).

When a chronic AP disease undergoes clinical progression, there is an associated progression in the pattern of some of the TR expressed in the diseased cells, although expression of the majority of TR involved will continue to be unchanged. This program progression has several possible consequences, including the consequence where the AP disease being expressed by the disease cells may become independent of some disease risk factor such as, for example, a mutated oncogene in the case of cancer. This is to be contrasted with what could be called acute AP diseases in which (a) at least one pathological risk factor must be currently acting on the diseased cells to produce the disease; (b) the disease is rapidly produced as a consequence; and (c) the disease involves a re-programming of the diseased cells. Perhaps the best example of this type of disorder are the result of an infection with certain pathogenic viruses (Table XII). It follows from the definition of these disorders as acute AP diseases that certain host cell-encoded regulators of cellular programming are appropriate targets for therapeutic intervention utilizing antisense ODNs disclosed herein, even if said TR do not directly up-regulate the expression of the virus in question. The host cell gene targets likely to be best suited for this purpose are TR and other molecules involved in the control of apoptosis and cellular responses to free radicals (Tables X and XI).

The interpretation of these viral diseases as being acute AP diseases leads to an important conclusion. That is, it will be possible to inhibit the expression of a TR encoded by the host cell where said TR is involved in controlling the cellular programming of that cell, such as, for example, by exposing that host cell to an antisense ODN directed to the particular TR in question, the antisense ODN being used either alone or in combination with an augmentation agent such as, for example, an anti-oxidant or an interferon. The impact of this ODN treatment on the programming of said cell will be different when comparing an uninfected with a similar cell expressing the infecting virus. The choice of antisense ODN for the purpose of this invention will be one that exploits this difference to a therapeutic advantage, such as, for example, blocking the ability of a virus to induce apoptosis. Thus, as in the case of the chronic AP diseases, this situation provides the basis for the novel approach to the development of therapeutic agents as described herein.

Nature of Targets

TRs are the primary targets for therapeutic manipulations based on the model. They may be manipulated directly or indirectly through molecules such as tyrosine kinase, that can effectively change a TR of one type to another through structural alterations such as phosphorylation.

While all the TR that are involved in cellular programming are, in accordance with the present invention, potential targets for therapeutic antisense ODNs for the disease(s) in which they are expressed, some TR appear to be more likely than others to be highly useful. There is growing evidence, for example, that many (if not all) of the chronic AP diseases frequently share a common type of insult which contributes to the pathogenesis of the disease. This insult consists of an attack on cells by oxygen free-radicals. In AIDS, for example, there is evidence that HIV-infected lymphocytes undergo apoptosis following exposure to free-radicals (Sandstrom et al., AIDS Res Human Retroviruses 9: 1107, 1993) At least in part this induction of apoptosis is mediated by lipid peroxidation (Sandstrom et al., J Biol Chem 269: 798, 1994). This general conclusion about AP Diseases suggests that (1) those cellular program regulators (TRs, in particular) that are involved with cellular responses to free-radicals should be given priority for testing as targets for antisense ODN inhibition in accordance with the concepts presented herein; and (2) there is a rationale for adding a free-radical generator or an antioxidant, whichever is appropriate, with one of the antisense ODNs disclosed herein for the treatment of an AP disease. Furthermore, these same pathways may also be activated by at least some pathogenic viruses that produce acute disease.

The free-radical generator could be used as an "augmentation agent" in combination with an antisense ODN designed in accordance with the present invention in diseases where the objective is to kill the AP cell (for example, atherosclerosis, or cancer) while the antioxidant would be appropriate as an augmentation agent where the objective is to block apoptosis (for example, AIDS). An antioxidant would be appropriate, also, in the latter cause, because many types of ODN themselves induce cells to generate free radicals. Free radical generators include, but are not limited to, certain polyunsaturated fatty acids (including gamma linolenic acid, eicosapentaenoate and arachidonate), chemotherapeutic agents and ionizing irradiation. Antioxidants include, but are not limited to, certain vitamins, minerals, trace elements and flavinoids. A complete listing of antioxidants would include those known to those skilled in the art, and may be found in standard advanced textbooks, such as, for example, Zubay G L: "*Biochemistry*" (3rd edition), in 3 Volumes, Wm C Brown Communications, Inc., 1993; and in: Rice-Evans CA and Burdon R H (eds): "*Free Radical Damage and Its Control*", New York: Elsevier, 1994; and in: Yagi K et al (eds): "*5th International Congress on Oxygen Radicals and Antioxidants*", New York: Excerpta Medica Press, 1992 (International Congress Series, No. 998). A partial listing of anti-oxidants that have been used clinically include, but are not limited to: ascorbic acid (vitamin C), allopurinol, alpha- and gamma-tocopherol (vitamin E), beta-carotene, N-acetyl cysteine, Desferol, Emoxipin, glutathione, histidine, lazaroids, Lycopene, mannitol, and 4-amino-5-imidazole-carboxamide-phosphate. The choice of which anti-oxidant(s) to use (if any) in conjunction with a particular antisense ODN can be determined on an ad hoc basis by one skilled in the art.

The principal effects of free-radical generators or antioxidants on cells from the perspective of the AP model is to produce an alteration in the pattern of TR being expressed, or, in the case of antioxidants, to prevent the effects on cells produced by cellulariy-generated free radicals subsequent to ODN binding. It follows from the AP model that this pattern will be different following treatment with these "augmentation agents" when normal cells are compared with AP cells.

Hence, it is possible to combine this treatment with an antisense ODN selected according to the criteria given herein (for example, in the Reprogramming Test) and expect different results for normal versus AP cells.

The TR that are known to be involved in cellular responses to free-radicals and apoptosis include, but are not limited to: the AP-1 group, including junD; the Egr group; gadd group; Hox group; IRF group; the MAD-, Max- and Mxi-groups; myc- and myb-groups; NF-kB group; p53; Ref-1; Sp-1; TR-3 and TR-4; and USF (for a more comprehensive list of TR, see Tables II and X). Other genes involved include those directly involved in the regulation of apoptosis, and are shown in Table XI.

It should be noted also that AP cells with major phenotypic differences in accordance with the AP model would be expected to have correspondingly somewhat different patterns of TR expression. One example is the multidrug resistance phenotype that is expressed by a substantial percentage of human cancer cells. Hence, it should be possible in accordance with the present invention to select antisense ODNs (preferably those directed to a TR involved in the maintenance of the multidrug resistance phenotype) and preferentially sensitize multidrug resistant cells to chemotherapeutic agents without getting a correspondingly increase in sensitivity to drug by drug sensitive cells.

Nature of Therapeutic Intervention

The basis of the novel therapy is to differentially change the pattern of gene expression in AP cells by altering the pattern of TR expression. The model states that the specific functional consequences of the expression of any given TR is context-dependent. It therefore follows that the same TR present in both normal and AP cells can be manipulated in the same way and a different impact on cellular behavior obtained. A TR expressed only by the AP cells, however, also may be targeted. The end result is that the pattern of gene expression in the AP cells lose at least a substantial portion of their disease-producing activity. This can be manifested in numerous possible ways including death of the AP cells, a change in their differentiation status with a concomitant change in the production of disease-producing factors or to a loss of proliferative potential.

The number of transcriptional regulators that will have to be manipulated in any given cell type will be very small. There are estimated to be 30,000 to 100,000 genes in the human genome distributed over $3 \times 10^9$ bp of DNA. In any given cell type approximately 10,000 genes can be shown to be expressed. Greater than 90% of these are expressed by many cell types and the large majority of these are referred to as "housekeeping genes."

Typically, the number of genes that can be shown to be differentially expressed in any given cell type account for only a few hundred. It is these genes that make the difference between liver cells and brain cells, for example. The large majority of these are directly involved in carrying out the functions that characterize the cell type. Liver cells, for example, express a wide range of enzymes that are involved in ridding the body of many types of chemicals. The genes of interest for the purposes of this patent are the small subset of genes coding for molecules involved in the differential regulation of cell type specific genes. In particular, transcriptional regulators and their direct modulators. The latter includes, for example, certain tyrosine kinases, that can modify a particular transcriptional regulator and, in effect, change it to a functionally different transcriptional regulator. (Berk Biochem Biophys. Acta. 1009, 103, 1989) For the purposes of this invention transcriptional regulators are defined as molecules that bind to specific DNA sequences variably expressed by different genes and/or to other transcriptional regulators at least one of which must bind to specific DNA sequences. As a result they control the levels of gene expressions by means of modulating RNA polymerase activity. The transcriptional regulators may be of either endogenous or exogenous origin. They may either be normal or be mutated.

The ability of transcriptional regulators to variably interact with each other provides the basis for a combinatorial regulatory system. This allows a very small number of transcriptional regulators to control the expression of a large number of genes in various patterns. Particular sets of genes being controlled at any given time by a certain subset of the transcriptional regulators being expressed by the cell. Each transcriptional regulator subset, therefore, is a programming code or an instruction or a "word" that directs the expression of a particular gene set. The entire pattern of gene expression being expressed by a given cell type can be thought of as a sentence, since only certain words can appear together. Perhaps the first demonstration of the involvement of combinatorial regulation in the control of a cellular differentiation program was provided by Chalfie and his colleagues as part of their studies of C. elegans (Mitani et al., Dev. 119: 773, 1993).

A general role for combinatorial regulation being involved in eukaryotic gene expression has been previously postulated by several investigators. (Scherrer, and Marcand J. Cell Phys 72, 181, 1968; Sherrer Adv. Esp. Med. Biol. 44, 169, 1924; Gierer Cold Spring Harbor Symp Quant Biol 38; 951, 1973; Stubblefield J. Theor Biol 118,129, 1986, Bodnar J. Theor Biol 132, 479, 1988) Lin and Riggs (Cell 4, 107, 1975), demonstrated using biophysical arguments the impossibility of having a separate regulator for every gene in a eukaryotic cell. Combinatorial regulation models of eukaryotic gene expression generally postulate multiple levels of regulation in addition to transcription. In principle, these models show how theoretically 100,000 genes could be selectively controlled by as few as 50 regulatory molecules only a small subset of which would operate at the level of what is defined here as transcriptional regulators. Bodnar J. Theor. Biol. 132, 479, 1988. The actual number of human transcriptional regulators are estimated to number on the order of somewhere in excess of 100. (Table II lists those that have been described in the literature.) Many, however, are known to be expressed only in certain cell types. Since just a few hundred genes determine the differences between particular differentiated cell types and the large majority of these determine the particular functional features of the cell, only a very small number of these can be regulator gene products.

It follows, therefore, that the number of regulators that must be manipulated to achieve the effects stipulated by this invention for any given application is small and can be managed with comparatively modest effort. It also follows from the notion of combinatorial regulation that not all the transcriptional regulators expressed by a given cell type need to be known before this invention can be practiced.

The present inventor has found that antisense p53 oligonucleotides can inhibit the proliferation. including the blocking of stem cell self-renewal, and ultimately kill primary human leukemic blasts while not producing similar effects on fresh normal bone marrow cells. This unobvious result indicates that the interactive mechanisms for detecting, interpreting and responding to environmental informational molecules involved in regulating cell differentiation and proliferation and viability in AP cells are so altered from normal in terms of their dynamic interactions (involving signal transduction and interpretation) that the inhibition of a single gene or set of genes coding for proteins involved in this process by antisense oligonucleotides is sufficient to change the impact of the informational molecules so a change in cellular programming such as cellular death or growth inhibition program can be selectively instituted in AP cells. The term "traitor genes" is used herein to describe those genes in AP cells that may be suitable for targeting for inhibition with antisense molecules in accordance with the present invention Suitable target or traitor genes may themselves either be functionally abnormal or be normal but function to maintain the pathological phenotype AP cells as part of an abnormal pattern of gene expression. Such treatment results in differential programming of AP cells, but not their normal counterparts over a selected dose range. In the preferred embodiment the Traitor Genes to be targeted are TRs.

The concentration of oligonucleotide to be used may vary, depending upon a number of factors, including the type of cancerous cells present in the marrow, the type, and the specificity of the particular antisense oligonucleotide(s) selected, and the relative toxicity of the oligonucleotide for normal cells. Although the present inventor has observed significant AP cell programming at oligonucleotide concentrations in extra-cellular fluid as low as 1 nanomolar, optimal inhibition was observed at concentrations of at least 10 nanomolar in the model system described below. The upper limit of the dosage range is dictated by toxicity and therapeutic efficacy, and, generally will not exceed 5 micromolar. With the aid of the techniques set forth in the present disclosure, those of skill in the art should be able to determine the optimal concentration to be used in a given case.

Phosphorothioates are currently the preferred chemistry for antisense ODNs to be used clinically. A substantial body of pharmacological/toxicological data for this class of compounds shows that phosphorothioates generally behave in a manner similar to most conventional drugs that are used systemically. As a result, the basic pharmacologic principals that have been established over the years apply here as well. For example, see the standard textbook: "*Principles of Drug Action: the Basis of Pharmacology*", 3rd Edition (W. B. Pratt and P. Taylor, eds). New York: Churchill Livingston, 1990. Thus, no novel pharmacologic principles or procedures have had to be invented in order to adapt phosphorothioates to in vivo use. There are some quantitative differences between phosphorothioates and more conventional drugs in terms of in vivo properties, but these differences can be accommodated to particular needs by one with ordinary skill in the art by an application of existing knowledge. In the future, undoubtedly, clinically-superior ODN backbones will be identified and/or developed. The "hotspots" for targeting specific genes and the prototype ODNs revealed herein should work equally well with any improvements in ODN backbone chemistry.

For the immediate purposes of this invention, phosphorothioate antisense ODNs can be administered intravenously (i.v.), intraperitoneally (i.p.), subcutaneously (s.c.) or intramuscularly (i.m.), in order to treat systemic disease. Pendent groups may be attached to the ODNs to aid tissue-specific targeting, or the ODNs may be associated with carriers that facilitate uptake, such as liposomes or charged lipids; in general, however, such modifications will not be necessary. Antisense ODNs can be delivered intrathecally or used in combination with agents that interrupt the blood-brain barrier in order to treat conditions involving the central nervous system. For local therapeutic purposes, phosphorothioates can be applied topically in an appropriate vehicle or delivered to particular organs or tissues by catheters (or catheter-like devices) designed to direct the flow of these compounds to particular sites in the body. Phosphorothioate antisense ODNs may also be administered orally, associated with one or more appropriate and acceptable carrier molecules or compounds, processed for oral ingestion in the form of a tablet, capsule, caplet or liquid. As described elsewhere herein, it may also be desirable to administer the antisense ODN with other active agents. For example, it may be desirable to add an antioxidant to an antisense ODN preparation, or to administer both antioxidant and antisense ODN simultaneously, to treat cancer patients whose tumors express a multidrug resistance phenotype; or to treat AIDS patients when the ODN backbone being employed is known to induce cells to generate free-radicals. Free radicals can induce cells to express higher levels of multidrug resistance, or boost the expression of HIV, respectively.

The extracellular concentrations that must be generally achieved with highly active phosphorothioate antisense ODNs is believed to be in the 10-1000 nanomolar (nM) range. These levels can readily be achieved in the plasma, for example, by infusing phosphorothioates into patients at a rate of a few milligrams per kilogram body weight per hour over a period of a few days. The infusion rate will typically be higher for cancer patients because they have higher levels of an as yet uncharacterized plasma protein that tightly binds phosphorothioates. As for many drugs, dose schedules for treating patients with phosphorothioates can be readily extrapolated from animal studies.

For ex vivo applications, the concentration of the antisense ODN(s) to be used is readily calculated based on the volume of physiologic balanced-salt solution or other medium in which the tissue to be treated is being bathed. In the large majority of applications, the phosphorothioates can be assumed to be stable for the duration of the treatment. With fresh tissue, 10-1000 nM represents the concentration extremes needed for an antisense phosphorothioate ODN with a reasonably good to excellent activity. Two hundred nanomolar (200 nM) is a generally serviceable level for most applications. Incubation of the tissue with the ODN at 5% rather than atmospheric (ambient) oxygen levels may improve the results significantly, except for unusual situations (such as bone marrow or peripheral stem cell purging with antisense ODNs directed to p53) where generation of highly-reactive free radicals appears to contribute to the desired therapeutic effects.

For some therapeutic applications, it may be preferable or even necessary to administer the antisense ODN with another augmentation agent. "Augmentation agents" as defined herein are those agents that can alter patterns of transcriptional regulator expression may include, but are not limited to: cytokines, cancer chemotherapeutic agents, neuroleptics, anti-inflammatory agents, anti-oxidants and free-radical generators such as certain polyunsaturated fatty acids. The suitability of such potential combination treatments generally can be determined initially in the "Reprogramming Test" prior to studies in animal model systems. It is also clearly desirable to add to the assay medium in the Reprogramming Tests of said cells any cytokines which may be associated in vivo with the diseased cells, in order to better model in vivo conditions. The association of particular cytokines with particular disease processes, or the usefulness of particular cytokines in clinical procedures has been well described in such standard reference works as: Thomson A W (Ed) "*The Cytokine Handbook*" (2nd Edition), San Diego: Academic Press, 1994; Kunkel S L and Remick D G: "*Cytokines in Health and Disease*", New York: Decker, 1992; and Oppenheim J J et al (Eds), "*Clinical Applications of Cytokines*", New York: Oxford Press, 1993. The choice of particular cytokines as augmentation agents for a particular disease application is to be limited to those cytokines to which the disease and cells in question respond. Cancer chemotherapeutic agents and free-radical generators could be used as augmentation agents in applications where the objective is to destroy the diseased cells, such as in, for example, cancer and atherosclerosis. Anti-inflammatory agents and anti-oxidants could be used as augmentation agents where the objective is to maintain the viability and/or reduce the pathogenicity of the diseased cells, such as in, for example, AIDS, Alzheimer's Disease, and autoimmune diseases. Neuroleptics could be used as augmentation agents in the treatment of diseases such as schizophrenia, where they have already shown activity.

"Hardware" for Reduction to Practice

Using established techniques, assays and agents, the following capabilities can be readily acquired. These can be used by anyone skilled in the art to reduce the primary and collateral inventions to practice.

1) Assays for transcriptional regulators and their direct modifiers.

Preferred assays: RNA in situ hybridization (Lum Biotech. 4, 32, 1986) or PCR (Block. Biochem 30, 2735, 1991) or metabolic labelling (Ausubel et al (eds.) Current Protocols in Molecular Biology, John Wiley N.Y., 1989 (updated semiannually)) for detecting expression at the protein level.

Purposes:

To establish the subset of the known transcriptional regulators or their direct modifiers that are expressed by a particular cell type. This will serve the following functions:
  a) the determination of the subset of transcriptional regulators, or their direct modifiers, that are targets to be manipulated in the reduction to practice;
  b) the evaluation of the effectiveness of potential therapeutic agents in adding or subtracting the expression of a particular transcriptional regulator or its direct modifier cells;
  c) the diagnosis and/or staging of a particular aberrant program disease;
  d) the determination of the optimum therapeutic agent(s) in clinical practice, when there are more than one option for a given disease.

2) Agents for adding or subtracting the expression of particular transcriptional regulators or their direct modifiers in cells to be therapeutically manipulated.
  a) Antisense oligonucleotides (Zon, Pharmaceut. Res., 5, 539, 1988).

These agents can be used to subtract the expression of particular genes from cells. Antisense oligonucleotides can produce an induction of their target gene by inducing an induction of their targe gene by inducing an initial reduction in expression that is then over compensated for as a consequence of a feedback loop in the cells or by altering the half-life and/or translational rate as a consequence of the antisense oligonucleotide producing a change in the target RNA secondary structure and/or by altering the binding of regulatory molecules to the target RNA. Such an action by antisense oligonucleotides is suitable for the practice of this invention.

Design of "Test" Antisense Oligonucleotides i) Using a computer program such as "Oligo" (Rychik and Rhoads, Nucl. Acids Res., 17, 8543, 1989) select a set of antisense oligonucleotides that bind to the RNA target of choice that have the following characteristics: (1) length between 10 and 35 bases with 20 being generally used; (2) negligible self-interaction (self-dimers and hair pins) under physiologic conditions; (3) melting temperature $\geq 40°$ C. under physiological conditions; and (4) no more than 40% of the oligonucleotide being a run of guanines or cytosines);

ii) Using a reference such as Genbank ensure that the antisense oligonucleotide has $\leq 85\%$ homology with the RNA transcripts of other genes. An exception to this is where an antisense oligonucleotide is selected on the basis of its ability to bind to more than one member of a transcriptional regulator family (such as the homeobox genes) on the basis of sequence homology.

b) Establishment of "prototype therapeutic" antisense oligonucleotide from a set of test antisense oligonucleotides. These prototype compounds will be used in the reduction to practice.
  i) Synthesize test antisense oligonucleotides using standard procedures, for example, those for producing phosphorothioates (Vu et al, Tetrahedron Lett, 32, 3005, 1991).
  ii) Using assays for transcriptional regulators or their direct modifiers select prototype therapeutic antisense oligonucleotides out of the set of test compounds on the basis of shutting down expression of the target gene in the cell types to be therapeutically manipulated. In practice, the same set of prototype agents capable of shutting down target gene expression in a variety of cell types could be used in the Reduction to Practice, Step 2, hereinafter, for multiple therapeutic objectives.

b) Synthetic double-stranded oligonucleotides that are ligands for the DNA binding domain of one or more transcriptional regulators. (Wu et al, Gene, 89, 203, 1990)

Prototype therapeutic agents of this type for use in the reduction to practice will correspond to actual gene sequences to which the transcriptional regulator(s) will have been shown to bind using standard techniques such as the gel mobility shift assay. (Ausubel et al (eds.) Current Protocols in Molecular Biology, John Wiley N.Y., 1989 (updated semiannually).) Alternatively, single stranded oligonucleotides targeted to transcriptional regulator binding sites and the adjacent sequences can also be used to block the expression of particular genes in accordance with the present invention.

c) Expression vectors

In the preferred embodiment a recombinant viral vector will be used (Miller and Rosman, Biotech, 7, 980, 1989) that carries the complete coding sequence of the transcriptional regulator or its direct modifier. This will provide for expression of the regulator or modifier in the cells of interest. It will be constructed and tested using standard methods. (Ausubel et al, supra) Alternatively, the viral vector will carry a sufficiently long antisense sequence to such a regulator or modifier to provide for the blocking of expression of the target gene in the cells of interest.

3) Preparation of Tissue

The preferred tissue is primary explant or early passaged. It will be acquired using standard surgical procedures. Tissue processing for culture and/or heterotransplant will be according to established methods. Culture conditions for the disordered cells from the various aberrant program diseases or their normal counterparts are referenced in Table III. These references also provide information on acquiring and processing the appropriate cells.

Uses to provide the source material for:
a) determining the subset of the known transcriptional regulators or their direct modifiers that are expressed by a particular cell type.
b) practicing the collateral inventions; that is, diagnosis and staging an aberrant program disease or for selecting optimal treatment in clinical practice.
c) evaluating possible adverse effects of treatments for aberrant program diseases on cultures of the three major constitutively self-renewing tissues (bone marrow, gastrointestinal epithelium, and skin). These cultures will also be used in some of the reductions to practice involving therapeutic manipulations of normal tissue. Culture conditions, Table IV.
d) The other cultures and heterotransplants to be used in the reduction to practice.

4) Discrimination of normal vs malignant cells in a mixed population.
Standard in situ hybridization procedures for detecting chromosome and/or translocation specific changes will be utilized. (Trask Trends in Genet. 7, 149, 1991).

5) Establish assays for scoring effects of manipulating transcriptional regulator function or their direct modifiers on cellular programming.
a) Aberrant program disease tissue
By definition the affected cells in these disorders express abnormal patterns of gene expression that produce the characteristic clinicopathologic features. Both of these can be monitored using established molecular and cellular techniques. The specific parameters to be assayed for each of the types of aberrant program disease given as examples are shown in Table III.
b) Normal tissue—
Reprogramming normal cell behavior where the relevant programs are differentiation, proliferation and viability could serve a variety of therapeutic uses. These would include but not be limited to certain in vitro and systemic treatments: (1) expansion of normal cell numbers in vitro prior to transplantation; (2) promotion of the growth of gastrointestinal cells in the treatment of peptic ulcers and inflammatory bowel disease; (3) liver regeneration, for example, following partial destruction by a virus or toxic chemicals; (4) expansion of one or more hematopoietic cell lineages for a variety of clinical purposes including reconstitution of immune function in immunodeficiencies, counteracting the effects of agents toxic to bone marrow and in fighting infection.
All of these changes in normal cellular programming can be readily assessed using established techniques.

B) Reduction to Practice
Step 1) Determine the subset of transcriptional regulators, and their direct modifiers, expressed by the aberrantly programmed tissue, the corresponding normal tissue, and the constitutively self-renewing normal tissue. Alternatively make a similar determination for any other normal tissue that is to be therapeutically manipulated in accordance with this invention.
Step 2) Add or subtract expression of transcriptional regulator(s) or their direct modifiers from cells to be therapeutically reprogrammed and the appropriate control tissue, as previously specified.
a) Addition—Use expression vector to insert expressible gene for a particular transcriptional regulator or a direct modifier of a transcriptional regulator into aberrantly programmed cells. The inserted gene will be one that is expressed by the corresponding normal cells, but not by the aberrantly programmed cells.
b) Subtraction—
i) can be achieved by the use of antisense oligonucleotides directed to the RNA of a particular transcriptional regulator or direct modulator or double-stranded oligonucleotide ligands for DNA binding domain of one or more transcriptional regulators
Using prototype antisense oligonucleotide(s) or double-stranded oligonucleotides block function of specific transcriptional regulator(s) in aberrantly programmed cells or normal cells to be therapeutically manipulated through reprogramming. Alternatively use an antisense oligonucleotide directed to a direct modifier of a transcriptional regulator.
ii) Using expression vector carrying antisense DNA directed to a particular transcriptional regulator or a direct modifier of a transcriptional regulator, install the new gene in aberrantly programmed cells. The therapeutic effect will be determined in advance through the use of an antisense oligonucleotide.

Step 3) REPROGRAMMING TEST:
Using the methods and procedures described in the "Hardware for Reduction to Practice" and using the information given in Tables III and IV, perform the following functions.
a) Utilize appropriate culture conditions for normal cells to be therapeutically reprogrammed or for AP disease, the AP cells plus the corresponding normal cells and constitutively self-renewing normal tissues (gastrointestinal, bone marrow, skin);
b) For AP disease, assay one or more pathogenic features of AP cells such as those shown in Table III and described in references in Table XIII, according to established procedures;
c) Treat cultures with prototype agent with reprogramming potential (as oligonucleotides to TR, as oligonucleotide ligands for TR, or expression vectors).
d) Score changes in programming and choose those agents that are therapeutically useful; for example:
1) cancer, myelodyspl asia and myeloproliferative-syndromeandatherosclerosis-kill AP cells;
2) AIDS, regenerate $CD4^+$ lymphocytes;
3) Expand normal hematopoietic stem cells for bone marrow transplant.
4) Alzheimer's cells: block apoptosis;
5) Rheumatoid arthritis: block inflammatory responses, and block joint destruction;
6) Schizophrenia: monitor in vitro predictors of potential for altering nervous system functioning to improve cognitive state of patients;

Step 4) Test effect of addition or subtraction of the function of particular transcriptional regulators using the agents selected in an animal model system if the therapeutic agents are for systemic use. (Table XIII)
Because of the need for a high degree of target homology with the corresponding human transcriptional regulator or its direct modulator the animals will of necessity nearly always be non-human primates. Immunocompromised animals xenotransplanted with human tissue are also of value for in vivo efficacy studies.
In the case of evaluating agents for the treatment of aberrant program diseases the animal may either be afflicted with the disease and both the efficacy of the treatment and the side effect documented or the animal may be normal and only the side effects tested.

Step 5) Any undesirable side effects that might be produced by the potential therapeutic agents can be reduced or eliminated in several possible ways, all of which can be implemented using existing technology.

a) Antisense oligonucleotides

FIG. 1 demonstrates that there are cell type specific differences in effects of particular antisense oligonucleotides targeted to different sites on specific RNA transcripts on cell behavior. Such differences can be used to select antisense oligonucleotides that produce the desired therapeutic effects with minimal undesirable side effects. These differences could be due to several factors, including differences in the availability of particular "hotspots" for antisense ODN binding between different cell types/specimens, aptameric or backbone effects.

b) Double-stranded oligonucleotide ligands Typically more than one transcriptional regulator can bind to the same double-stranded DNA sequence, but with variable affinities. It is, therefore, possible to change the competitive inhibitor effect of such an agent relative to the potential set of target transcriptional regulators by introducing base changes. These can include mismatches. The melting temperature of the two resulting strands, however, must be $\geq 40°$ C. under physiologic conditions. The effect of such changes, therefore, can produce a more favorable therapeutic index.

c) Expression vectors

The levels of expression and efficiency of gene transfer can be readily adjusted on a tissue specific basis by changes in the viral envelope and/or the promoter/enhancer combination used to achieve gene expression.

The forgoing, then, can be reduced to a novel "Method of Rational Discovery" for antisense oligonucleotides for the treatment of Aberrant Programming disease comprising the following steps:

(i) select one or more transcriptional regulator gene targets implicated in the regulation of cellular programming in the Aberrant Programming Disease, these targets also being expressed by the diseased cells to be reprogrammed;

(ii) select one or more prototype antisense oligonucleotides to target transcripts of the selected transcriptional regulators, where the prototype antisense oligonucleotides are chosen from among those targeting gene "hotspots" defined by the Tertiary Selection Method, as described hereinafter;

(iii) evaluate the prototype antisense oligonucleotides in the Reprogramming Test for their capacity to therapeutically reprogram the Aberrant Programmed disease cells while at the same time not adversely reprogramming normal cells;

(iv) combine the selected prototype antisense oligonucleotide with another augmentation agent which is capable of altering the pattern of transcriptional regulator expression through a change in the expression of or physical state of the TR, where the TR is expressed in the Aberrant Programmed cells, to discover if the agent improves the ability of the selected antisense oligonucleotide to therapeutically reprogram the Aberrant Programmed cells;

(v) design sequence- and length-variants of the selected prototype antisense oligonucleotides which scored well in the Reprogramming Test (i.e., which exhibited capacity to reprogram Aberrant Programming cells); the variants should be selected so that they bind to sites overlapping or contiguous to the binding site of the corresponding prototype antisense oligonucleotide, and have negligible capacity to form self-complementary dimers or hairpin structures;

(vi) evaluate these variant ODNs alone, or with the agent selected in step (v), in the Reprogramming Test for capacity to effectively reprogram the Aberrant Programmed disease cells in the Aberrant Programming Disease while not adversely reprogramming normal cells; and then (vii) test the most active of the evaluated antisense oligonucleotides, either alone or with the agent selected in step (v), for therapeutic efficacy in an animal model system if the therapeutic agents are for systemic use.

(viii) evaluate the data, and select the antisense ODN which exhibits the best therapeutic index with the least toxicity, for potential use as a therapeutic agent in clinical trials.

Demonstration of the Reduction to Practice with a P53 Target

Step 1—

It is known that p53 is expressed by primary human leukemia blast cells using the metabolic labeling technique (Smith, et al., J. Exp. Med. 164, 751, 1986.)

Step 2—

A set of four different phosphorothioate antisense oligonucleotides directed to p53 RNA were prepared using an Applied Biosystems, Inc. (ABI) DNA synthesizer (Model 380B) according to the manufacturer's protocols. An antisense oligonucleotide against the HIV rev gene was used as a negative control. The sequences are set forth in the Sequence Listing hereinafter as SEQ ID NOS: 1-4. These were used to treat primary human leukemic blasts, normal human bone marrow, normal human circulating T-lymphocytes, normal adult human gastrointestinal epithelium, normal human fetal gastrointestinal epithelium and Rhesus monkey T-lymphocytes. Destruction of p53 RNA by the antisense p53 oligonucleotides was documented using PCR and/or dot blotting.

The four p53 sequences are as follows:

```
SEQ ID NO.1:    5'-AGTCTTGAGC ACATGGGAGG-3'    C(1)p53

SEQ ID NO.2:    5'-ATCTGACTGC GGCTCCTCCA-3'    A(1)p53

SEQ ID NO.3:    5'-GACAGCATCA AATCATCCAT-3'    A(3)p53

SEQ ID NO.4:    5'-CCCTGCTCCC CCCTGGCTCC-3'    OL(1)p53
```

Step 3—

The following effects of the antisense p53 oligonucleotides on cellular programming were evident from the results found.

1) They can irreversibly block the proliferation of, block stem cell self-renewal, or kill human cancer cells. This coupled with the lack of toxic effects on normal tissue indicates these agents can have a role in the treatment of cancer. (See Tables V-VIII).

2) They promote the proliferation of gastrointestinal epithelium, indicating a role in the treatment of peptic ulcer and inflammatory bowel disease (FIG. 1). The suppressive effect of these agents on mature lymphocyte (Table IX) proliferative also supports their role in diseases such as inflammatory bowel disease that have an autoimmune component.

3) The data also demonstrates that there are cell type specific differences in responses to antisense oligonucleotides targeted to different sites on RNA transcripts of the same gene (FIG. 1). This provides a basis for optimizing therapeutic effects and for minimizing undesirable side effects.

4) These results support the general principle that antisense oligonucleotides directed to a transcriptional regulator can be used to expand particular normal adult or fetal tissues in vitro that could then be used for various medical purposes including transplantation (FIG. 1).

5) The cell type dependency of the effects of particular antisense oligonucleotides directed to a transcriptional regulator support the cellular program model in general and the aberrant program model in particular.

Step 4—

The ability of the antisense p53 oligonucleotides to recognize the p53 RNA of Rhesus monkeys was demonstrated by showing a similar inhibitory effect on mature T-cell proliferation for both Rhesus and human cells (Table IX).

Two Rhesus monkeys weighing 8.9 kg and 6.8 kg were infused with 52.5 mg and 75.8 mg of the OL(1)p53 antisense oligonucleotide (SEQ ID NO:4) which was radiolabeled over four hours. In keeping with rodent data, tissue distribution analysis showed substantial oligonucleotide uptake compared to the levels needed to block p53 expression. Excretion studies demonstrated retention of the infused agent for more than two weeks. During this time and subsequently, the animals were extensively monitored for signs of toxicity and none were seen. These and additional results were reported in: Cornish KG, P Iversen, L Smith, M Arneson and E Bayever: *Cardiovascular effects of a phosphorothioate oligonucleotide with sequence antisense to p53 in the conscious Rhesus monkey*. Pharm. Comm. 3(3): 239-247 (1993), which is expressly incorporated herein by reference.

It was not possible to do in vivo efficacy studies with the p53 antisense ODN in an animal model for two reasons: (1) there were no readily-available animal model systems that utilized freshly-obtained human leukemia cells as xenotransplants, including no readily available primate leukemia animal models; (2) there is at best only a modest effect of the p53 antisense ODN on established in-vitro-adapted human leukemia cell lines, in contrast to the significant p53 effects observed on primary (fresh) human leukemia cells in vitro. These latter data were reported in: Bayever E, L Smith et al: *Selective cytotoxicity to human leukemic myeloblasts produced by oligodeoxyribonucleotide phosphorothioates complementary to p53 nucleotide sequences*. Leukemia and Lymphoma 12: 223-231 (1994), which is expressly incorporated herein by reference.

Step 5—

Since no unacceptable side effects were produced in the monkeys, it has not been necessary to modify the antisense oligonucleotides.

Step 6—

The non-toxicity of the antisense p53 phosphorothioate oligonucleotide OL(1)p53 was confirmed after systemic administration into humans in a Phase I clinical trial designed with the review and approval of the U.S. Food and Drug Administration. The initiation of this world's-first clinical trial of systemically-administered antisense ODN was reported by: Bayever E, L Smith et al: *Systemic human antisense therapy begins*. Antisense Res. Develop. 2: 109-110 (1992), which is expressly incorporated herein by reference.

In addition to the treatment of patients with cancer, the p53 antisense ODNs may be used to treat certain other diseases or medical conditions that include, but are not limited to, the following: AIDS; Atherosclerosis/restenosis; Alzheimer's disease; autoimmune diseases including, for example, multiple sclerosis, rheumatoid arthritis, and systemic lupus erythematosus, in accordance with the AP model. The results may be substantially improved by adding either a free-radical generator or an anti-oxidant as augmentation agents, as previously described. In addition, free-radicals may cause an alteration in the conformation of p53, with the result that p53, so altered, can function like an essentially different TR (Maxwell and Roth: Crit. Rev. Oncog. 5: 23, 1994; Hainaut and Milner: Cancer Res. 53: 4469, 1993). In this instance, a free-radical generator or redox modifier used to produce this effect would be a direct modifier of p53. These p53 antisense ODNs, used alone or with an augmentation agent, may also be used to block apoptosis in damaged normal tissue, for example, as a result of blood vessel occlusion and/or reperfusion injury, or ionizing radiation damage to the skin.

Novel Computer-Based Method for Selecting Target Sites for Highly Active Antisense ODNs The four p53 antisense ODNs (SEQ ID NOS. 1-4) mentioned above were all designed using the method described above under the title "*Design of 'Test' Antisense Oligonucleotides*", along with certain other considerations. The general area to which A(1)p53 (SEQ ID NO.2) and A(3)p53 (SEQ ID NO.3) were targeted were, or were thought to be, the translational start site for regular or for alternatively spliced p53, respectively. The practice of targeting antisense ODNs to areas of RNA transcripts thought to have a regulatory role (beyond coding a protein) is well established in the literature. C(1)p53 (SEQ ID NO:1) was targeted to a general area of approximately 150 base pairs (bp) in length that was selected by a computer program designed to pick out potential functional areas in nucleotide sequences. The basis of this latter program is Chaos Theory. This C(1)p53 oligonucleotide binds to one strand of the DNA duplex in the p53 gene that includes a transcriptional regulator binding site.

In contrast, the target area for OL(1)p53 (SEQ ID NO.4) was selected from a group of possible sites within the p53 transcripts, without consideration of whether or not a biologically significant function was associated with any of these regions of the p53 transcript. Instead, the inventor simply further restricted the criteria presented under "*Design of 'Test' Antisense Oligoriucleotides*". The restriction was to obtain an ODN with the highest possible $T_m$ value (equivalent to lowest $\blacktriangle G°$ value) without compromising the other selection criteria. In subsequent discussions which follow, the originally-described selection method and criteria under the title "Design of 'Test' Antisense Oligonucleotides" will be termed "the primary selection method", while the method with the more restricted criteria to be described next will be termed "the secondary selection method." Again, it was this secondary selection method that was utilized to design OL(1)p53.

The "OLIGO" computer program (Version 3.4), created by Dr. Wojciech Rychlik (Rychlik and Rhoads, Nucleic Acids Res. 17: 8543, 1989; copyright 1989), was utilized in all of the hotspot selections included herein. This is the same "OLIGO" computer program originally used by the present inventor to examine the p53 cDNA sequence. The p53 sequences were examined using computer-generated probe of all possible antisense ODNs containing 20 nucleotide bases (i.e, a "20-mer") that could bind with the p53 cDNA. The inventor instructed the computer program to calculate the binding affinities for these antisense ODNs under the conditions of 138 mM salt and an ODN concentration of 250 nM. Next, the inventor asked the computer to list all of the possible 20-mer antisense ODNs that would have negligible self complementarity, which is defined as not having hairpin structures within the 20-mer (neither negative nor positive ▲G° values), and no self dimerization with more than two continuous base matches. Using the "Option 'Z'" function in the "OLIGO" program, the program was then asked to print out a list of the 5-prime terminal base positions of the sites on the p53 sense strand to which the ODNs would bind, the extreme 5'-nucleotide of the entire gene/cDNA sequence as it came from Genbank or the literature being designated nucleotide position number 1. These sites were entered into the primary array of the program's memory. Next, using the memory for the secondary array, all the 20-mer ODNs with a higher binding affinity for their target than a certain value (again, selected by the inventor) were entered. In standard physical chemistry terms, the more negative the value of the ▲G° indicated for a particular 20-mer ODN, the higher the binding affinity to its corresponding target sequence. Therefore, beginning with a ▲G° value of –43.0 kcal per mole (kcal/mol), and then making the ▲G° value more negative in steps of –2 kcal/mol (i.e., for example: –45 kcal/mol, –47 kcal/mol, –49 kcal/mol), the inventor directed the computer to compare primary and secondary arrays and to print out the start sites for all the 20-mers meeting the criteria used in both arrays. The inventor initially decided intuitively that he would assume that the more negative the kcal/mol value for a given 20-mer ODN (i.e., the more tightly it bound to its corresponding target sequence), the higher would be the biological activity of the corresponding antisense ODN. This assumption could then be tested.

Next, the 20-mers meeting the criteria in both arrays were examined to further determine the suitability of these antisense ODNs. Any ODN having four (4) or more guanine bases in a row were eliminated. Originally, this was done because ODNs having four or more guanine bases in a row were thought to be more difficult to synthesize. More recently, however, it has been determined that four guanine bases in a row may cause the formation of a "G-quartet" which, through formation of intermolecular complexes, may cause production of significant adverse, sequence-specific, non-antisense effects on cells. Further, any ODN having ≧85% match (i.e., 17 matches out of 20 bases) with any other known human gene sequence whose blockade by ODN would negatively influence the therapeutic utility of the antisense ODN in question were also eliminated. OL(1)p53 constituted the single 20-mer antisense ODN that met all these individual criterion and which had the most negative ▲G° value (–47.5 kcal/mol) when these criteria were applied to the p53 gene/cDNA sequence (Lamb and Crawford, Mol. Cell. Biol. 6: 1379, 1986).

Finally, the method for selecting antisense ODNs underwent a final stage of development to yield the "tertiary selection method." It is this tertiary selection method that was used to select the many additional "hotspots" and prototype antisense ODNs that are disclosed herein. The tertiary selection method consists of the following steps: (1) the secondary selection method is utilized to find the binding sites for the ODNs that have a high probability of being the most active, with one modification: i.e., 22-mer lengths of ODN rather than 20-mer was used for probing the target gene sequences. This was accompanied by a decrease in the required –kcal/mol value for binding affinity to –45.0 kcal/mol for primary hotspots. Identification of a continuous and contiguous run of 5'-end starting positions on the computer print out was considered to reveal the core of a "hotspot" for antisense ODN targeting. Using the OLIGO program in the manual mode, examining contiguous overlapping binding sites on either side of the "core hotspot" for self-complementarity, potential antisense ODNs varying in size from 16-27 nucleotides in length were identified. Of these, ODNs contiguous with the core hotspot were rejected if they were shown to contain sequences which would generate a stable self hairpin structure with a negative ▲G° value (<1.0 kcal/mol) as calculated by the OLIGO program, and/or if the ODN was estimated to have significant self dimerization at 37° C. (Self dimerization is most readily evaluated by using the upgraded OLIGO program in Version 4.0). Once all of the acceptable contiguous ODNs are determined by this procedure, then the "hotspot" has been defined. As a rule of thumb, the present inventor has determined that if 10 such hotspots can be identified for a particular gene target, then one should find that at least three (3) of these sites will yield very highly active antisense ODNs, and this probability is inversely correlated with the calculated –kcal/mol binding affinity for the antisense ODN in question. Most of the prototype antisense ODNs designed by the inventor for the evaluation of these hotspots are 22-mers that optimize minimal self interaction with a large –kcal/mol value. In some instances, these parameters can best be optimized by going to a longer or a shorter antisense ODN. Multiple active antisense ODNs within any given "hotspot" are needed for several reasons, including the possibility that some ODNs will have unexpected but biologically important aptameric (or aptameric-like) effects which may either increase, decrease, or have no effect on the therapeutic endpoint to which the antisense ODN in question is directed.

Not all gene targets will yield 10 or more hotspots according to the criteria just presented. In these cases, additional ("alternative" or "secondary") hotspots can be found by manually examining each of the areas of the gene that yield antisense ODNs with the highest binding affinity for their targets as measured by the calculation of the –kcal/mol value (this, too, is to be considered part of the tertiary selection procedure). Each of the potential antisense ODNs in these areas are examined for self complementarity using the aforementioned relaxed standards of no hairpin structures with self-binding affinities of ≦1 kcal/mol or significant self dimerization at 37° C. as judged by the OLIGO program, version 4.0. The set of contiguous overlapping antisense ODNs uncovered in this way then define a "hotspot" within the transcript (sense) sequence. Again, the prototype antisense ODNs selected for each of these hotspots are optimized for two (2) parameters which are minimal self interaction, and a more highly negative kcal/mol value for binding to the target site in the gene transcript.

Using this tertiary selection method, the most highly active antisense ODNs for blocking the expression of particular genes can be discovered. The steps are: (1) design antisense ODNs according to the tertiary selection method; (2) synthesize and test the prototype antisense ODNs for each hotspot; (3) pick the most active prototype antisense ODNs; and (4) design and test new variants derived from these prototypes. The variants should be designed to bind further upstream or downstream of the prototype, in short steps of two or three bases, and variants of shorter or longer lengths varying by two bases at a time should be tested. In an initial test to determine if shortening the ODN improves its antisense activity, or to determine if shifting the ODN two bases downstream improves antisense activity, for example, the subsequent variants that continue in the same direction of change should be evaluated. All of these variants, however, will fit into the range of possible antisense ODNs defined by the corresponding hotspot.

Following standard drug development procedures, these antisense ODNs will be first tested in vitro for activity whenever possible, and for toxicity. Next, in vivo studies of potential efficacy (where there is an appropriate animal model) (Table XIII) and pharmacology/toxicology analyses will be carried out. Antisense ODNs successfully making it to this stage of development will be subject also to any additional studies that might be required by the U.S. Food and Drug Administration for achieving approval of an Investigational New Drug (I.N.D.) application.

Testing of the Novel Computer-Based Method for Selecting Target Sites for Highly Active Antisense ODNs.

Example 1

In vitro comparisons of the relative activity levels of the four p53 antisense ODNs (SEQ ID NOS. 1-4) showed that OL(1)p53 (SEQ ID NO.4) was consistently the most active in terms of producing anti-tumor effects. Freshly obtained acute myeloid leukemia (AML) blast cells, as well as ovarian, colon, lung and brain cancer specimens, were tested. In nearly every experiment in which the four p53 antisense ODNs were evaluated simultaneously on such tumor specimens, the OL(1)p53 antisense ODN exhibited the most potent activity. Activity was determined as a reduction in viable cell counts and by reduced capacity of treated cells to grow in methyl cellulose as colonies in colony forming assays, compared to cells treated with control ODNs. The results with fresh AML blast cells have been published (Bayever et al., *Leukemia and Lymphoma* 12: 223-231,1994). These data were consistent with the notion that the secondary selection method would yield ODN sequences with a greater probability of being the most highly active than selecting ODNs by applying the primary selection method to regions of transcripts thought to have an important regulatory function beyond encoding for a particular protein (such as the 5'-cap site, the AUG start site, or splice junctions).

Example 2

Having discovered a method for selecting highly active antisense ODNs, the present inventor designed a series of antisense ODNs against two other gene targets in order to further test and confirm the value of the selection method herein disclosed. The MDR1 gene that encodes P-glycoprotein, and the gene encoding the multidrug resistance-associated protein (MRP) were selected for these studies. The protein products of these genes constitute molecular pumps that have been implicated in the production of the multidrug resistance phenotype in cancer cells. Hence, antisense ODNs with the capacity to block the expression of these genes would be expected to increase the sensitivity of treated multidrug resistant tumor cells to chemotherapeutic agents such as vincristine, doxorubicin and VP-16. The entire MDR1 gene has been cloned and sequenced, while only the MRP cDNA has been cloned and sequenced. Consequently, there is a much larger number of functional sites that can be targeted on the MDR1 transcript.

The primary selection method was used to design antisense ODNs to target selected regions of the MDR1 transcript; the functional significance of the selected regions had been described (Chin et al., Mol. Cell. Biol. 9: 3808, 1989; Chen et al., J. Biol. Chem. 265: 506, 1990; Kohno et al., J. Biol. Chem. 265: 19690, 1990). These regions included the 5'-cap site, the 5'-untranslated leader, splice junctions and the translational start site (containing the AUG codon). These types of functional sites have frequently been identified as suitable targets by other investigators. In addition, other antisense ODNs were selected using the secondary selection method described herein, and also by the method for finding alternative or secondary hotspots described herein; these ODNs will be discussed hereinafter.

To determine relative activity among the various MDR1 antisense ODNs, they were incubated at several different ODN concentrations in cell culture medium with the human multiple myeloma cell lines 8226/Dox4 or 8226/Dox6 (gifts of Dr. William Dalton, University of Arizona Cancer Center, Tucson) (Dalton et al., Cancer Res. 46: 5125, 1986). Specifically, the human myeloma cells were incubated with the antisense ODNs for four (4) days, in a humidified, 5% $CO_2$ atmosphere containing a reduced oxygen level of 5%, maintained by purging the culture incubator with nitrogen gas in place of ambient room air. Addition of an antioxidant to the cultures during exposure of the cells to the ODN further reduces the effects of the free radicals induced by the ODNs on cells (this effect can include increased expression of MDR1). The cell cultures were then incubated with a chemotherapeutic anti-cancer agent overnight (15-18 hrs), after which the cell cultures were washed repeatedly and then seeded into 96-well microtest plates to permit quantitative analysis of their growth. Tritiated-thymidine was added to these cultures for 18-hrs prior to termination of the assays on day 4 following exposure to the anticancer agents. Each test combination of cells, antisense ODN and anti-cancer agent was run in quadruplicate replicates.

The data for MDR1 antisense ODNs are shown in Table XIV, and show that the most active ODNs were those which had been selected using the secondary selection method. In this Table, the most active MDR1 antisense ODN is OL(1 C)mdr. Re-iterating, the criteria of the secondary selection method (1) permit no self interactions in the ODN (such as hairpin structures) and no more than two contiguous base pair matches in self-dimers; and (2) maximize the negativity of the calculated –kcal/mol value to ensure the most avid binding of the antisense ODN to its corresponding target sequence, without compromising the other criteria provided. These are the same parameters that were used to select the OL(1)p53 antisense ODN (SEQ ID NO.4).

Next, variants of OL(1)mdr and OL(12)mdr—the most active of the antisense ODNs targeting MDR1 transcripts—were tested. The results of one such experiment are shown in Table XV and in FIG. 2. Among the several OL(1)mdr variants, OL(1C)mdr and OL(1 Q)mdr were found to be two of the most active in terms of producing the greatest "fold-increase" in drug sensitivity, when calculated using as the "treatment control" cells treated only with culture media ("Method 2", last two columns, Table XV). If, on the other hand, the "treatment control" cells used in the calculation were cells treated with the corresponding ODN ("Method 1", middle two columns, Table XV), then the OL(1C)mdr variant is calculated to be less active than certain other MDR-ODNs, including OL(12)mdr, OL(12A)mdr and OL(1B)mdr. The OL(1)mdr ODN and its variants were selected using the secondary selection method, while the OL(12)mdr ODN and its variants were selected using the method for finding alternative, or secondary, "hotspots".

Figure 2:
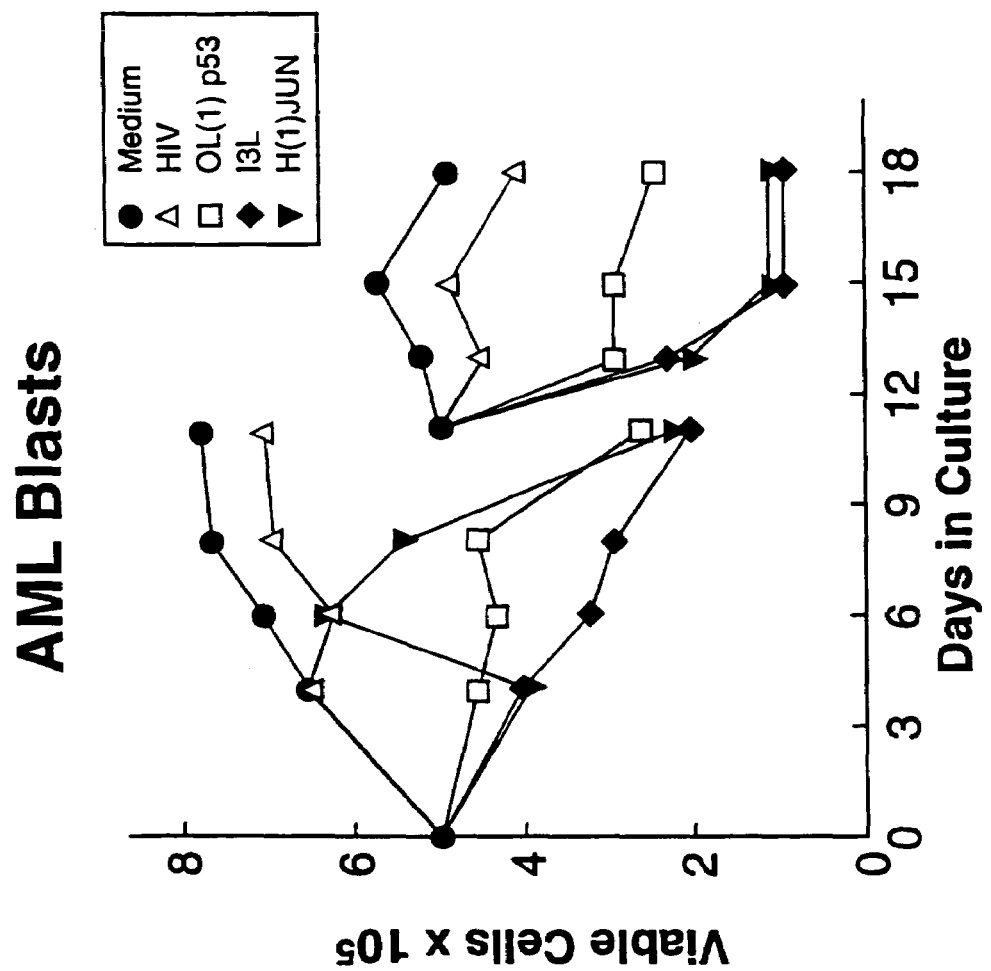
FIG. 2 is a graph showing the effects of different antisense oligonucleotides on viability of AML blasts.

The very high potency of the OL(1 C)mdr prototype MDR-ODN on 8226/Dox4 cells, however, appears possibly to be due to a combined antisense effect on MDR1 transcripts and to an aptameric-like effect that also can cause suppression of MDR1 expression in these highly drug resistant cells. This aptameric-like effect is also associated with a partial inhibition of proliferation of this highly P-glycoprotein expressing cell line (FIG. 2). It is this effect that explains the differences seen with the "Media Control" versus "Corresponding-ODN Control" in calculations of fold-increases in drug sensitivity of ODN-treated cells (Table XVI). A likely explanation for this aptameric-like effect is that the ODNs showing this effect are binding to cellular proteins involved in the regulation of MDR1 expression, such as, for example, protein kinase C and/or protein kinase A.

The enhanced reduction in P-glycoprotein expression due to the combined antisense and aptameric-like effects likely causes the associated reduction in cell proliferation. It has been previously shown that treating P-glycoprotein-expressing cells with monoclonal antibodies capable of binding to and blocking P-glycoprotein function leads to a substantial reduction in the proliferation of the treated cells. The fact that OL(1C)mdr is more active than OL(12)mdr and it variants on cell lines that express less P-glycoprotein (such as 8226/Dox6 and CEM/VLB cells) is consistent with this hypothesis. It is also possible that the aptameric-like effect that leads to a reduction in P-glycoprotein expression also inhibits a cellular pathway involved in proliferation, such as the protein kinase C pathway. The lack of the aptameric-like effect on less drug-resistant cells, or on drug sensitive cells, could reflect the fact that such cells do not have the up-regulated PKC pathway commonly seen in highly drug-resistant cell lines (Table XVII). The relative ranking of the most potent MDR-ODNs was confirmed using less drug-resistant P-glycoprotein-expressing CEM human leukemia cells. The MDR-ODNs showing the aptameric-like effect on 8226/Dox4 cells did not produce this effect on these P-glycoprotein-expressing CEM cells. The term "aptameric-like" is used because the effect seen is seen with some sequences but not others (aptameric); aptameric-like effects are substantially more common among ODN sequences than are the usual aptameric effects. OL(1C)mdr did not produce drug sensitization of drug sensitive lines, and has no significant effect on the proliferation or differentiation of normal human bone marrow progenitor cells in standard in vitro assays. In general, this situation in which the antisense and an aptameric-like effect of an ODN both act to reduce expression of the same gene (e.g., MDR1) can be expected to be a very uncommon finding among antisense ODN therapeutics directed to other gene targets. Hence, despite the calculated (Method 2) superiority of OL(12) and its variants over OL(1C)mdr, it appears reasonable to conclude that OL(1C)mdr is the more active antisense ODN.

Example 3

As was done for the MDR1 gene transcripts in Example 2, the primary selection method was also used to design antisense ODNs to target selected regions within the MRP cDNA gene transcript, based on what is known in the literature about the functions of the various regions of the transcript (Cole et al., Science 258: 1650, 1992). Functional sites targeted included the 5'-cap site, the 5'-untranslated leader and the translational start site. In addition, other antisense ODNs were selected using the secondary selection method described above.

Relative antisense ODN activity among the various MRP antisense ODNs was determined in exactly the same manner as was described in Example 2 above for analysis of the MDR1 antisense ODNs, except that the MRP antisense ODNs were tested on the MRP-expressing, multidrug-resistant A427 human lung cancer cell line (Giard et al., J. Natl. Cancer Inst. 51: 1417, 1973). Table XVI summarizes the prototype MRP antisense ODNs tested in these studies, and shows their relative ranking in terms of in vitro drug-sensitizing activity. OL(8)MRP, which was selected using the secondary selection method, was found to be the most effective among the various MRP antisense ODNs tested.

Based on the results of our studies of variants of the most active antisense ODNs selected by the Secondary Selection Method, the latter selection method was modified to become the Tertiary Selection Method already described.

These data support the notion that the method of selecting "hotspots" for targeting antisense ODNs and for determining the best antisense ODNs for any given hotspot will yield highly active antisense ODNs for any gene of choice. These, in turn, can be used for the therapeutic purposes disclosed herein.

Evaluation of the Usefulness of the Aberrant Programming Model with the Novel Method Presented Herein for Selecting Highly Active Antisense ODNs for the Discovery of Antisense ODNs for Therapeutic Use in the Aberrant Programming Diseases The most important feature of the invention disclosed herein is the fact that it makes possible a straight-forward and comparatively simple approach to the discovery of novel therapeutics for the treatment of several major diseases that historically have been intractable with respect to the development of new therapies, such as, for example, cancer, atherosclerosis, AIDS and Alzheimer's Disease. Specifically, the Aberrant Programming disease model combined with the method disclosed herein for selecting highly active antisense ODNS makes the discovery of new therapeutic agents for these diseases a comparatively small scale screening process. In contrast, for example, conventional drug development for cancer has yielded no major new breakthrough drugs for more than a decade, despite the huge expense and the screening of hundreds of thousands of compounds.

To demonstrate a reduction of this invention to practice, the inventor decided to select a very small number of gene targets from those predicted by the Aberrant Programming model to be of therapeutic use and to design and test antisense ODNs directed to these targets on normal and cancer cells. The first gene target selected was junD (Hirai et al., EMBO J. 8: 1433, 1989; Ryder at al., Proc. Natl. Acad. Sci. USA 86: 1500, 1989). The reasons were the following: (1) junD is a TR involved in the control of cellular programming; (2) it is expressed by many types of both normal and malignant cells; and (3) the expression levels of junD and its physical state appear to be the same in both normal and malignant cells. Therefore, junD appears to be neither an oncogene nor an anti-oncogene in actual tumors seen in patients (certain junD mutants may, however, function as an oncogene in some experimental situations). Hence, if treatment of normal and malignant cells with antisense ODNs to junD leads to adverse effects on malignant but not on normal cells, then such data would constitute prima facia evidence in support of the Aberrant Programming model and its value for the development of novel therapeutics.

Example 4

Two junD antisense ODNs were tested in vitro: H(1)junD (SEQ ID NO. 5) and H(2)junD (SEQ ID NO. 6):

```
SEQ ID NO.5:   H(1)junD   GTCGGCGTGG TGGTGA

SEQ ID NO.6:   H(2)junD   GCTCGTCGGC GTGGTGGTGA
```

Control ODNs included those which had the same nucleotide base sequence but in the reverse order, as well as ODNs which were directed to irrelevant genes. These ODNs were designed using the criteria listed for the primary selection method, with the added restriction that (a) only hotspots capable of giving rise to antisense ODNs with no hairpins and no more than two contiguous base matches in a row for self-dimers were allowed; and (b) the melting temperature ($T_m$) had to be $\geq 40°$ C. for a 20-mer (corresponding to a negative kcal/mol value of $\leq -33.8$ kcal/mol or even more negative. Under these conditions, 26 acceptable hotspots were identified. The inventor decided to test initially antisense ODNs with binding affinities in the mid-range between the maximal value of $-33.8$ and the preferred values of $\leq -46.0$ kcal/mol. The hotspot with the 5'-terminal nucleotide of 515 was chosen. The corresponding 20-mer prototype antisense ODN [=H(2)junD] had a binding affinity of $-43.0$ kcal/mol. There were 11 acceptable hot spots in the junD sequence that would yield prototype antisense ODNs with this or even greater binding affinity. Based on subsequent work by the inventor, the selection criteria used for H(1)junD and H(2)junD ODN are expected to yield good but not necessarily exceptional antisense ODNs.

In the initial tests, the H(1)junD oligo or a control ODN were incubated with AML blast cells for seven days. The blast cells were freshly obtained from patients with AML and were cultured and evaluated for ODN effects as described by Bayever et al.(*Leukemia and Lymphoma* 12: 223-231, 1994). In brief, after the incubation with ODNs, the blast cells were then washed, and adjusted to $10^5$ cells per ml and continued in culture for several more days. Viable cell counts were performed every 2-3 days on suspension cultures and oligo-treated blast cells were plated in the "blast colony assay" to determine the effects of the ODNs on the leukemic stem cells. A representative example of the suspension culture data is shown in FIG. 3. H(1)junD is consistently found, as in the example shown, to have as great or a greater antileukemic effect than OL(1)p53. Similarly, H(1)junD has been found to have anticancer effects on solid tumors such as, for example, ovarian carcinoma.

To test the effects of the H(1)junD ODN on normal cells, normal human bone marrow cells were incubated with from 10 nM to 10 µM of the H(1)junD ODN for 7 days. The bone marrow cells were cultured and evaluated as described in Bayever et al. (op.cit.). In brief, viable cell counts were performed every two days following ODN treatment and then the cells were plated in mixed colony assays to determine what effects (if any) the ODNs would have on the proliferation and differentiation of various types of hematopoietic colony forming units. H(1)junD was not found to have any impact on normal cell growth, viability or differentiation.

When the H(1)junD and H(2)junD ODNs were tested on malignant cell lines, they were found to have less of a cytotoxic or anticancer growth-inhibitory effect than they had on freshly-obtained cancer specimens. However, the inventor discovered that these antisense ODNs could be used to dramatically sensitize various types of multidrug-resistant cancer cells to anti-cancer chemotherapeutic agents. Remarkably, these sensitizing effects were operative on cancer cells that have differing mechanisms for their multidrug resistance. Table XVII shows that H(1)junD or H(2)junD can be used to sensitize P-glycoprotein-expressing drug-resistant 8226/Dox cell to vincristine, while H(1)junD also can sensitize DU-145 prostate cancer cells that express MRP and not P-glycoprotein. These finding support the conclusion that suppressing the expression of junD, such as by treatment with antisense ODNs, can be used to reverse multidrug resistance resulting from any of a variety of mechanisms, including those that require expression of molecular transporters such as P-glycoprotein and MRP, and perhaps also the less-well characterized drug resistance mechanisms such as those producing resistance to cisplatin and related compounds. It has also been found that junD is up-regulated in cancer cells following treatment with the chemotherapeutic agent Ara-C (Kharbanda et al., Biochem. Pharm. 45: 2055, 1993). Hence, increased junD expression could be part of a cellular response mechanism that tends to block the toxic effects of chemotherapeutic agents on cancer cells.

In contrast to the effects on multidrug resistant cancer cell lines, the H(1)junD ODN had minimal sensitizing potential when used to treat drug-sensitive (parent) cancer cell lines (Table XVII). This difference in the responsiveness of the drug-resistant versus drug-sensitive cancer cells to H(1)junD is consistent with the prediction made by the Aberrant Programming model that the pattern of transcriptional regulator expression associated with different states of the Aberrant Programming diseases will vary in such a way that the effects of modulating these patterns with any particular modulator will produce somewhat different effects, depending on the specific character of the Aberrant Programming disease cells. Hence, the need for the type of novel diagnostic and prognostic testing disclosed herein. The junD antisense ODN data taken as a whole also illustrate that junD is involved in an abnormal combinatorial regulation system that maintains both (a) the viability of cancer cells, and (b) the drug resistance phenotype.

In conclusion, the Aberrant Programming model coupled with the antisense ODN 30 selection method disclosed, can readily be used to identify novel antisense ODNs with therapeutic potential for treating Aberrant Programming Diseases.

Selection of Hotspots and Prototype Antisense ODNs for Transcripts of Genes of Therapeutic Importance The tertiary selection method was applied to more than 200 genes and the resulting hotspots and prototype antisense ODNs are disclosed herein, in Tables XVIII and following. The selection of this large number of genes is based on the Aberrant Programming model and on the scientific literature concerning the probable/possible involvement of particular molecules or types of molecules in particular disease processes. The details of this extensive literature is readily available to anyone through computer searching of a variety of scientific and medical databases, using "keyword" searches. The list of genes for which hotspots have been identified herein should be expanded in the future. Certain genes (human) that are clearly of potentially great therapeutic importance have been identified, but either the gene sequences have not been made available or only partial sequences are available. The genes in the former category include telomerase which is implicated in the promotion of cancer, and several of the homeobox genes (including Hox A1, Hox A10, Hox B6, Hox C6, Hox 2.4, Hox 2.6 and Hox 5.4) which fall into both sequence categories. The homeobox genes are apt to be important for more than one of the Aberrant Programming diseases, and some are likely to be regulators of telomerase expression, for example. TR that are required for telomerase expression are potential targets for antisense therapeutics for the treatment of cancer. Once the MRP gene is completely sequenced, it is likely that the new sequence data will allow for more useful antisense ODNs to be designed for therapeutic inhibition of the gene. Other genes that are to be included in the list of possible therapeutic targets, for which sequences are not yet available, are mdm-2, LBP-1a,b,c and d, Rp-8, fos-B, ATBF1, hu-cut, maf, ERP, ELAM-1, ERM, AP-12, SAP-1, OxyR (human counterpart), HES-1, NM23-H1, LR1, and E2F1. Application of the tertiary selection method disclosed herein can and will be readily applied to these gene Treatment of Atherosclerosis Using Antisense ODNs directed to Transcriptional Reaulators or their Direct Modulators The present inventor, to the best of his knowledge, was the first to describe the c-myc gene (and perhaps the c-myb gene, as well) as being potentially useful gene targets for the treatment of atherosclerosis, since these gene targets encode transcriptional regulators known to be involved in the control of cellular programming. As previously reviewed herein, antisense ODNs directed to c-myc or c-myb have now been shown to have in vivo activity for inhibiting the proliferation of smooth muscle cells (SMC) following balloon angioplasty in atherosclerosis. In these publications, only a single c-myc antisense ODN, however, directed to the transcript of the human c-myc gene, has been tested. Analysis of this 15-mer c-myc antisense ODN by the criteria disclosed in the present invention indicate that this 15-mer is a very sub-optimal antisense ODN for the purpose of reducing c-myc expression. Specifically, it has four guanines in a row which may cause the formation of a "G-quartet" (as does the c-myb antisense ODN used to treat SMC) which is apt to inhibit the proliferation of some normal cell types independently of any direct effect on c-myc expression. In fact, it has been shown in the inventor's laboratory that an oligonucleotide comprising the reverse sequence of this 15-mer c-myc antisense ODN inhibited the proliferation of human lung cancer cell lines nearly as well as did the c-myc antisense ODN (unpublished data). Furthermore, the published 15-mer c-myc antisense ODN has a greater degree of self dimerization than is acceptable according to the criteria herein described in the present application, since it has six (6) contiguous base matches; similarly, it has a much lower binding affinity for its target than is desirable even in a 15-mer (only being –30.9 kcal/mol). The application of the tertiary selection method described herein will provide much improved c-myc antisense ODNs, as well as highly active c-myb antisense ODNs useful for modulating expression of the human c-myb gene, although the c-myb sequence has not proven to be a particularly good target.

It also is likely that the Reprogramming Test disclosed herein could be used to find genes that would be more suitable targets for antisense ODNs for the treatment of atherosclerosis/restenosis than are the c-myc and c-myb genes. This assumes, however, that the SMC involved in restenosis are atherosclerotic and not normal. If this is the case, then restenosis is just a particular form of atherosclerosis. Indeed, it could be argued that the published c-myc and c-myb antisense ODNs that have been used in the restenosis system work simply by inhibiting cell proliferation, and that many other antisense ODNs directed to other gene targets involved in the control of cell proliferation would work equally well. Such a broad effect based simply on inhibiting a cellular program (proliferation) from proceeding is very different from the cellular reprogramming effect which is the basis of the AP model approach. With respect to the strategy of simply inhibiting the proliferation of SMC following angioplasty, it would be preferable to use gene targets for antisense ODN inhibition that are more restricted to SMC than are c-myb or c-myc; such as, for example, NF-IL6. Antisense ODNs that can be effectively used to block cell proliferation have been disclosed herein.

According to the Aberrant Programming model, atherosclerotic SMC will express a different pattern of TR than is to be found in normal SMC. Therefore, finding the most appropriate TR target gene(s) requires a comparison of the effects of potential therapeutically-useful antisense ODNs on atherosclerotic SMC, along with normal cells (normal SMC, and normal bone marrow if possible). It would be preferable for the treatment of atherosclerosis generally to identify an antisense ODN capable of selectively inducing programmed cell death (or "apoptosis") in the atherosclerotic SMC while sparing normal cells. This could be achieved by the use of antisense ODNs of the type disclosed herein, used either alone or in combination with another augmentation agent also capable of modulating TR expression in atherosclerotic SMC, such as, for example, a growth factor. Miano et al.(Amer. J. Pathol. 142: 715, 1993) have observed that the TR c-fos, fos-B, fra-1, c-jun, jun-B and junD are expressed by SMC. Each of these, along with c-myc and c-myb, should be evaluated in the Reprogramming Test applied to atherosclerosis. The p53 gene is also expressed in atherosclerotic SMC and should be tested as a target gene along with genes regulated by p53, as well as those which, in turn, regulate p53 expression. These genes, along with the genes previously mentioned that are implicated in controlling changes in cellular programming in response to oxidative damage, should be evaluated as potential therapeutic targets for inhibition by antisense ODN. Atherosclerosis has been postulated by some to be an inflammatory disease linked to an abnormality in oxidation-mediated signals in the vasculature (Offermann et al., Heart Dis. Strokes 3: 52, 1994). Any other TR (or the direct modulators of the TR) involved in the control of cellular reprogramming that can be shown to be expressed in atherosclerotic SMC should also be evaluated in the Reprogramming Test. The preferred methods for screening for the expression of TR are provided herein. In addition, antisense ODNs directed to genes involved in programmed cell death (i.e., apoptosis) should be evaluated in the Reprogramming Test using atherosclerotic SMC. Genes such as E2F-1 and cyclin-A or cyclin-D1 that have been implicated in the expression of c-myc also should be given priority testing (Oswald et al., Oncogene 9: 2029, 1994). A listing of some of the in vitro and in vivo assays that should be of use for developing antisense ODNs for the treatment of AP diseases (including atherosclerosis) are provided in Table XIII.

The antisense oligonucleotide selected for practice of the invention may be any of the types described by Stein and Cohen, Cancer Research 48:2569-2668 (1988), and including without limitation, unmodified oligodeoxynucleotides, ethyl- or methylphosphonate modified oligodeoxynucleotides, phosphorothioate modified oligonucleotides, dithioates, as well as other oligonucleotide analogs, including those incorporating ribozyme structures, and oligoribonucleotides such as those described by Inove et al., Nucleic Acids Res. 15:6131 (1987); and Chimeric oligonucleotides that are composite RNA, DNA analogues (Inove, et al, *FEBS Lett.* 2115: 327 (1987). Oligonucleotides having a lipophilic backbone, for example, methylphosphonate analogs with ribozyme structures, may prove advantageous in certain circumstances; these molecules may have a longer half-life in vivo since the lipophilic structure may reduce the rate of renal clearance while the ribozyme structure promotes cleavage of the target RNA. Gerlach, Nature 334:585 (1988). Oligonucleotides with 2'-O-methylmodifiedribose sugars are also suitable for the practice of this invention. This ribose sugar modification can be used with a variety of backbone types such as phosphorothioates and may be limited to only some of the sugar residues such as those at the ends of the oligonucleotide.

The oligonucleotides may be formulated into pharmaceutical compositions and administered using a therapeutic regimen compatible with the particular formulation. As described further below, with the aid of present disclosure, those of skill in the chemotherapeutic arts should be able to derive suitable dosages and schedules of administration for any of a number of suitable compositions that contain the compounds. Thus, pharmaceutical compositions within the scope of the present invention include compositions where the active ingredient is contained in an effective amount to kill the cells of the cancer without causing unacceptable toxicity for the patient. However, a preferred dosage comprises that which is sufficient to achieve an effective blood concentration of between about 1 and about 5 micromolar. Although a preferred range has been described above, determination of the effective amounts for treatment of each type of tumor may be determined by those of skill in the art of chemotherapeutic administration.

In addition to the antisense oligonucleotide compounds, the pharmaceutical compositions of the invention may contain any of a number of suitable excipients and auxiliaries which facilitate processing of the active compounds into preparations that can be used pharmaceutically. Preferably, the preparations will be designed for parental administration. However, compositions designed for oral or rectal administration are also considered to fall within the scope of the present invention. Preferred compositions will comprise from about 0.1 to about 1% by weight of the active ingredients.

Suitable formulations for parental administration include aqueous solutions of the active compounds in water-soluble or water-dispersible form. Alternatively, suspensions of the active compounds may be administered in suitable lipophilic carriers. The formulations may contain substances which increase viscosity, for example, sodium carboxymethyl cellulose, sorbitol, and/or dextran. Optionally, the formulation may also contain stabilizers. Additionally, the compounds of the present invention may also be administered encapsulated in liposomes. The oligonucleotide, depending upon its solubility, may be present both in the aqueous layer and in the lipidic layer, or in what is generally termed a liposomic suspension. The hydrophobic layer, generally but not exclusively, comprises phospholipids such as lecithin and sphingomyelin, steroids such as cholesterol, more or less ionic surfactants such a diacetylphosphate, stearylamine, or phosphatidic acid, and/or other materials of a hydrophobic nature.

While the present invention has been described in conjunction with a preferred embodiment and specific examples, the description is not meant to limit it. One of ordinary skill, with the aid of the present disclosure, may be able to effect various changes, substitutions of equivalents and other alterations to the methods and compositions set forth. Therefore, the protection granted by Letters Patent should not be limited except by the language of the claims as set forth below.

TABLE I

Analogy with Language
The following analogy with language illustrates the essential nature of the model of clinical cancer given in the patent application and the basic rationale for using antisense oligonucleotides directed against the indicated target or traitor genes as therapeutic agents. It should be clear that this is a novel, inventive and useful approach.

RULES:

| | Biology | Language Equivalent |
|---|---|---|
| 1. | The instructions for a particular pattern of gene expression (program) where key programs are differentiation, viability and proliferation | word |
| 2. | Transcriptional Regulators (or any of the other types of regulators listed as target or traitor genes) | letters |
| 3. | Programmed cell death | nonsense letter combination |
| 4. | Malignant cells have different program instructions than corresponding normal cells and normal cells in general | malignant cells express unique words |
| 5. | Normal cells at different stages of differentiation express different program instructions than other cell types | different normal cell types have their own vocabulary |
| 6. | All or nearly all the letters used by malignant cells are structurally normal and appear in normal cells | the alphabets of normal and malignant cells are essentially the same |
| 7. | As particular programs unfold, the pattern of regulators expressed changes | cells express different words at different program stages |

Note: The words used in the following examples have only a loose correlation to actual cellular behaviors or programs.

Hypothetical Example

| | Cell Type 1 (e.g. liver) | Cell Type 2 (e.g. kidney) |
|---|---|---|
| Normal | retard | stop |
| Low grade malignant | start | swarm |
| High grade malignant | spread | grow |

Comments—

I. ANALOGY WITH BASIC CLINICOPATHOLOGIC MECHANISMS a) "T" and "P" in normal cell type 2 but not in malignant type 1 could be considered analogous antioncogenes since they must be deleted for malignant progression. That is, for the word "stop" to be changed to the word "swarm". These deletions must occur along with the deletion of "o" and the addition of "w", "a", "r" and "m". The same letter "p", however, appears in the high grade malignant type 1 cell, while "t" appears in the low grade form. This fits the observations that antioncogenes are far from universally deleted in human cancers, that multiple genetic changes appear to be involved in carcinogenesis and that clinical cancers typically evolve phenotypically.

b) "m" and "w" could be considered analogous to "oncogenes" since they are required for "stop" evolving to "swarm" and they are not expressed in other normal adult cells. Alternatively, "m" and "w" could be normally only expressed at the embryonic-fetal stage of development.

c) "s" becomes expressed in the malignant forms of type 1 cells (ectopic expression) while it is normally expressed in type 2, but not type 1.

II. ANALOGY WITH ANTISENSE OLIGONUCLEOTIDE TREATMENT STRATEGY a) Inhibition of "t" expression will kill low grade type 1 calls but not normal cell types 1 and 2, because "start" becomes "sar" which is not a word, but "retard" and "stop" become "read" and "sop" respectively which are both words.

b) Blocking "m" but not "w" will kill malignant cell type 2 at the low grade phase since "swarm" minus "m" becomes "swar" which is not a word; but "swarm" minus "w" becomes "rams", a word.

d) Knocking out "a" will kill low grade 1 and 2 and high grade 1, but it also kills normal cell type 1. So antisense inhibition of "a" might be useful for purging bone marrow of malignant cell type 1 or 2 but not for systemic treatment.

TABLE I-continued

Analogy with Language
The following analogy with language illustrates the essential nature of the model of clinical cancer given in the patent application and the basic rationale for using antisense oligonucleotides directed against the indicated target or traitor genes as therapeutic agents. It should be clear that this is a novel, inventive and useful approach.

e) Deletion of "r" would not kill normal cell type 1 ("retard" becomes "date"), but it would kill three of the four malignant cell types. The exception being low grade 1 where "start" becomes "sat".
f) Removal of "e" kills normal and high grade type 1, so it would not be expected to be a good target for systemic therapy.
g) Of the remaining letters elimination of "d" or "g" will not result in the death of any of the cell types; removal of "s" will kill high grade 1, but none of the other cell types it appears in; blocking "o" will kill both malignant forms of type 2; and inhibition of "p" will kill high grade 1 but not normal type 2.

TABLE II

Human Transcriptional Regulators

| Members | Family | Where known to be expressed | Representative Reference | Possible Direct Modifications | Reference |
|---|---|---|---|---|---|
| p 53 | — | proliferating mature T and B lymphocytes, numerous types of cancer | Kern, et al., Sci. 252, 1708, 1991. | phosphorylation | Smith, et al., J. Exp. Med. 164, 751, 1986. |
| AZO | — | endothelial cells | Opipari, et al., J. Biol. Chem. 265, 14705, 1990. | — | — |
| AF-1 | — | liver | Metzger, et al., J. Bid. Chem 265, 9978, 1990. | — | — |
| AP-2 | — | cell lines | Comb and Goodman, Nucl. Acids Res. 18, 3975, 1990. | — | — |
| AP-4 | — | cell lines | Hu, et al., Genes and Dev. 4, 1741, 1990. | — | — |
| ATF1-8 | ATF | cell lines | Hoeffler, et al., Mole. Endocrine 5, 256, 1991. | — | — |
| C/EBP | — | liver | Friedman and Muknight, Genes and Dev. 4, 1410, 1990. | — | — |
| CHF.10 | — | cell lines | Pannuti, et al., Nucl. Acids Res. 16, 4227, 1988. | — | — |
| CHF.12 | — | cell lines | Pannuti, et al., Nucl. Acids Res. 16, 4227, 1988. | — | — |
| CRE-BP1 | — | fetal tissue, cell lines | Maekawa, et al., EMBO J. 8, 2023, 1989. | — | — |
| CREB | — | cell lines | Muchardt, et al., J. Virol. 64, 4296, 1990. | phosphorylation | Hoeffler, et al., Mol. Endo. 5, 256, 1991. |
| E12 | — | cell lines | Mosse, et al., Cell 56, 777, 1989. | — | — |
| E47 | — | cell lines | Mosse, et al., Cell 56, 777, 1989. | — | — |
| E2A | — | all blasts | Kamps, et al., 60, 535, 1990. | — | — |
| EBP1 | — | cell lines | Clark, et al., Genes Dev. 2, 991, 1988. | — | — |
| EGR 1-3 | EGR | cell lines, PMA induced mononuclear cells | Rangnekar, et al., Nucl. Acids Res. 18, 2749, 1990. | — | — |
| EGR 1,2 | ETS | cell lines | Watson, et al., PNAS 85, 7862, 1988. | — | — |
| ETS 1,2 | ETS | T lymphocytes, fetal liver, astrocytes | Bhat, et al., PNAS 87, 3723, 1990. | — | — |
| GLI-1-3 | GLI | embryonal carcinoma, myometrium, testis, placenta | Ruppert, et al., Mol. Cell. Biol. 8, 3104, 1988. | — | — |

TABLE II-continued

Human Transcriptional Regulators

| Members | Family | Where known to be expressed | Representative Reference | Possible Direct Modifications | Reference |
|---|---|---|---|---|---|
| HKR1-4 | HKR | testis, placenta, kidney, colon, lung, brain, embryomal carcinoma | Ruppert, et al., Hal. Cell. Biol. 8, 3104, 1988. | — | — |
| HOX 1.4, 2.1, 2.2, 2.3, 2.4, 2.5, 2.6, 2.7, 2.8, 2.9, 5.1, 5.2, 5.4, 6.1, 6.2, 7 | homeobox | cell lines, embryos | | | |
| HPFp1-9 | HPFp | placenta | Bellefroid, et al., DNA 8, 377, 1989. | — | — |
| H-plk | — | placenta | Kato, et al., Mol.. Cell. Biol. 10, 4401, 1990. | | |
| HS1 | — | lymphocytes | Kitamura, et al., Nucl. Acids Res. 17, 93167, 1989. | | |
| hXBP | — | lymphocytes | Liou, et al., Sci. 247, 1581, 1990. | | |
| $I_KB$ | — | placenta | Zabel and Baeuerle, Cell 61, 255, 1990. | | |
| ISGF1-3 | — | cell lines | Pine, et al., Mol. Cell. Biol. 10, 2448, 1990. | — | — |
| JUNB | JUN | cell lines | Nomura, et al., Nucle. Acids Res. 18, 3047, 1990. | — | — |
| C-JUN | JUN | cell lines | Nomura, et al., Nucle. Acids Res. 18, 3047, 1990. | — | — |
| JUN-D | JUN | cell lines | Nomura, et al., Nucle. Acids Res. 18, 3047, 1990. | | |
| K8 | homeobox | cell lines | Kongsuwan, et al., EMBOJ. 7, 2131, 1988. | — | — |
| lyl-l | — | cell lines | Mellentin, et al., Cell 58, 77, 1989. | | |
| MAX | — | cell lines | Blackwood and Eisenman, Sci. 251, 1211, 1991. | — | — |
| MBP-1 | — | cell lines | Baldwin, et al., Mol. Cell. Biol. 10, 1406, 1990. | — | — |
| A-myb | myb | cell lines | Normora, et al., Nucl. Acids Res. 16, 11075, 1988. | — | — |
| B-myb | myb | cell lines | Normora, et al., Nucl. Acids Res. 16, 11075, 1988. | | |
| C-myb | myb | cell lines, hematopoietic tissue | Normora, et al., Nucl. Acids Res. 16, 11075, 1988. | — | — |
| C-myc | myc | cell lines, hematopoietic tissue | Gazin, et al., EMBOJ. 3, 383, 1984. | | |
| L-myc | myc | placenta, lung cancer | Kaye, et al., Mol. Cell. Biol. 8, 186, 1988. | — | — |
| N-myc | myc | neuroblastoma | Slaman, et al., Sci. 232, 768, 1986. | — | — |
| myfS | — | muscle | Braun, et al., Nature 346, 663, 1990. | | |
| NF-E1,2 | NF-E | hematopoietic cells | Mignotte, et al., Nucl. Acids Res. 17, 37, 1989. | — | — |
| NFE6 | NF-E | hematopoietic cells | Colin, et al., J. Biol. Chem. 265, 16729, 1990. | — | — |
| NF-µE1 | — | lymphocytes | Sen and Saltimore, Cell 46, 705, 1986. | — | — |

TABLE II-continued

Human Transcriptional Regulators

| Members | Family | Where known to be expressed | Representative Reference | Possible Direct Modifications | Reference |
|---|---|---|---|---|---|
| NF-µE3 | — | lymphocytes | Sen and Saltimore, Cell 46, 705, 1986. | — | — |
| NFGMa | — | embryonic tissue, hematopoietic cells | Shannon, et al., Mol. Cell. Biol. 10, 2950, 1990. | — | — |
| NFGMb | — | hematopoietic cells | Shannon, et al., Mol. Cell. Biol. 10, 2950, 1990. | | |
| NF-IL6 | — | monocytes | Akira, et al., EMBO J. 9, 1897, 1990. | — | — |
| NP-$_K$B | — | lymphocytes, cell lines | Ruben, et al., Sci. 251, 1490, 1991. | — | — |
| NF-5 | — | lymphocytes | Kobr, et al., Mol. Cell. Biol. 10, 965, 1990. | — | — |
| 225 | — | cell lines, lymphocytes | Wright, et al., Sci. 248, 588, 1990. | — | — |
| 243 | — | lymphocytes | Bours, et al., Nature 348, 76, 1990. | — | — |
| Oct 1 | Oct | cell lines | Johnson, et al., Mol. Cell. Bid. 10, 1982, 1990. | — | — |
| Oct 2 | Oct | cell lines | Johnson, et al., Mol. Cell. Biol. 10, 1982, 1990. | — | — |
| Oct. 3 | Oct | embryonic | Scholer, et al.. EMBO J. 9, 2185, 1990 (murine) | — | — |
| Pit-1 | — | pituitary | Chen, et al., Nature 346, 583, 1990. | — | — |
| PL1 | homeobox | cell lines | Shen, et al., PNAS 86, 8536, 1989. | — | — |
| Pr1 | homeobox | cell lines | Kamps, et al., Cell 60, 547, 1990. | — | — |
| Rb | — | hematopoietic cells, retinal cells | Lee, et al., Sci. 235, 1394, 1987. | phosphorylation | Yen, et al., Exp. Cell. Res. 192, 289, 1991. |
| RF-y | — | cell lines | Reith, et al., Cell 53, 897, 1988. | — | — |
| RF-x | — | lymphocytes | Reith, et al., Genes Dev. 4, 1528, 1990. | — | — |
| Rhombotin | — | cell lines | McGuire, et al., Mol. Cell. Biol. 9, 2124, 1989. | — | — |
| SCL | — | fetal liver, hematopoietic cells, placenta | Beyley, et al., PNAS 86, 10128, 1989. | — | — |
| Sp-1 | — | cell lines | Pugh and Tjian, Cell 61, 1187, 1990. | — | — |
| SRF | — | cell lines | Norman, et al., Cell 55, 989, 1988. | — | — |
| Tal | — | cell lines | Chen, et al., EMBO J. 9, 415, 1990. | — | — |
| TCF-1 | — | lymphocytes | Van de Wetering, et al., EMBO J. 10, 123, 1991. | — | — |
| TFE3 | — | lymphocytes | Beckmann, et al., Genes Dev. 4, 167, 1990. | — | — |
| VAu | — | hematopoietic cells | Katzav, et al., EMBO J. 8, 2283, 1989. | — | — |
| cfos | fos | hematopoietic cells | Runkel, et al., Mol. Cell. Biol. 11, 1270, 1991. | phosphorylation | Barber and Verma, Mol. Cell. Biol. 7, 2201, 1987. |

TABLE II-continued

Human Transcriptional Regulators

| Members | Family | Where known to be expressed | Representative Reference | Possible Direct Modifications | Reference |
|---|---|---|---|---|---|
| fos-B | fos | cell lines | Mumberg et al. Genes Dev, 5, 1212, 1991 | — | — |
| fra-2 | fos | cell lines | Nishina et al., PNAS. 87, 3614 1990 (chicken) | — | — |
| glucocorticoid receptor | steroid receptor super family | lymphocytes and numerous other cell types | O'Malley, Mole Endocrin., 4, 363, 1990 | — | — |
| androgen receptor | steroid receptor super family | male reproductive organs, muscle | O'Malley, Mole Endocrin., 4, 363, 1990 | — | — |
| progesterone receptor | steroid receptor super family | female reproductive organs | O'Malley, Mole Endocrin., 4, 363, 1990 | — | — |
| estrogen receptor | steroid receptor super family | female reproductive organe | O'Malley, Mole Endocrin., 4, 363, 1990 | — | — |
| estrogen related receptors | steroid receptor super family | female reproductive organs | O'Malley, Mole Endocrin., 4, 363, 1990 | — | — |
| retinoic acid receptor | steroid receptor super family | hematopoietic cells, epithelial tissue | O'Malley, Mole Endocrin., 4, 363, 1990 | — | — |
| thyroid hormone receptor | steroid receptor super family | numerous tissues | O'Malley, Mole Endocrin., 4, 363, 1990 | — | — |
| vitamin D receptor | steroid receptor super family | hematopoietic and many other cell types | O'Malley, Mole Endocrin., 4, 363, 1990 | — | — |
| mineralocorticoid receptor | steroid receptor super family | kidney, colon, salivary glands | O'Malley, Mole Endocrin., 4, 363. 1990 | — | — |
| MZF-1 | Kruppel zinc finger like family | CML, placenta | Hromas, et al., J. Biol. Chem. 266, 14183, 1991 | — | — |
| HB9 | homeobox | hematopoietic, fetal | Deguchi and Kehrl, Blood 78, 323, 1991 | — | — |
| HB24 | homeobox | hematopoietic, fetal | Deguchi and Kebrl, Blood 78, 323, 1991 | — | — |
| vHNF1 | homeobox | liver | Bach, et al., Nucl. Acids Res. 19, 3553, 1991 | — | — |
| HOX11 | homeobox | liver, some T cell leukemias | Hatano, et al., Sci 253, 79, 1991 | — | — |
| PL2 | homeobox | cell lines | Lowney, et al., Nucl. Acids Res. 19, 3443, 1991 | — | — |
| rel | | cell lines | Brownell, et al., Mol. Cell Biol. 5, 2826, 1985 | — | — |
| HSF | | many cell types | Cunniff, et al., Mol. Cell Biol. 11, 3504, 1991 | — | — |
| NF-AB | | cell lines | Won and Baumann, Mol. Cell Biol. 11, 3001, 1991 | — | — |
| CCG1 | | cell lines | Sekiguchi, et al., Mol. Cell Biol. 11, 3317, 1991 | phosphorylated | Sekiguchi, et al., Mol. Cell. Biol., 11, 3317, 1991 |

TABLE II-continued

Human Transcriptional Regulators

| Members | Family | Where known to be expressed | Representative Reference | Possible Direct Modifications | Reference |
|---|---|---|---|---|---|
| rhom-2 | rhombotin | cell lines, embryonic tissue | Buehm, et al., PNAS 88, 4367, 1991 | | |
| rhom-3 | rhombotin | cell lines | Buehm, et al., PNAS 88, 4367, 1991 | | |
| GATA-3 | | T cells | Ho, et al., EMBO J. 10, 1187, 1991 | | |
| IP-1 | | cell lines | Auwerx and Sassone-Corsi, Cell 64, 983, 1991 | phosphorylated | Auwerx and Sassone-Corsi, Cell 64, 983, 1991 |

TABLE III

Scoring Features of Aberrant Programming Associated with Pathological Effects

| Disease | Cell Type | Representative Culture References | Pathological Features of Aberrant Programming | Pathologic Change Reference |
|---|---|---|---|---|
| Cancer | A) Hematopoietic | A-1) Eaves, et al., J. Tiss. Cult. Math. 13, 55, 1991. A-2) Messner, et al., Blood 70, 1425, 1987. A-3) Uckin and Heerema, Leuk. Lymph, 2, 1, 1990. A-4) Caligaris-Cappio, et al., Blood 77, 2688, 1991. A-5) Hoang and McCulloch, Blood 66, 748, 1985. | 1) inappropriate proliferation 2) ability to survive in inappropriate sites in body 3) inappropriately invasive | 1-3) Kissane (ed) Anderson's Pathology C. V. Mosby St. Louis, 9th ed. 1990. |
| | B) Solid Tissue | B-1) Moyer, J. Tiss. Cult. Meth. 8, 63, 1983. B-2) Moyer and Poste (eds.). Colon Cancer Cells, Academic Press, San Diego, CA 1990. (Dr. Moyers' culture system works for most primary human sarcomas and carcinomas) | | |
| Myelo-dysplasia | hematopoietic | a) Firken, et al., Br. J. Haemat. 75, 476, 1990. b) Aoki, et al., Amer. J. Hemat. 35, 6, 1990. c) Nagler. et al., Blood 76, 1299, 1990 | 1) impairment of blood cell differentiation as judged by standard clinical diagnostics 2) impaired colony formation by multi-potential progenitors 3) immune abnormalities including (a) deficits in CD4' lymphcytes and (b) decreased NK cells 4) apoptosis 4c) suppressed clonal expansion of myeloid progenitors from patients but not normals in presence of patient serum | 1-3) List, et al., J. Clin. Oncol. 1424, 1990. 4) Clark and Lampert, Leuk. Lymph. 2, 415, 1990. 4c) Donohue, et al., Nature 326, 200, 1982. |
| Myelo-proliferative Disorders | hematopoietic | a) Eaves, et al., J. Tiss. Cult. Meth. 13, 55, 1991. b) Messner, et al., Blood 70, 1425, 1987. c) Fauser and Messner, Blood 58, 1224, 1981. | inappropriate clonal proliferation of particular blood cell lineage | Adamson and Fi-alkon, Br. J. Haemat. 38, 299, 1978. |

TABLE III-continued

Scoring Features of Aberrant Programming Associated with Pathological Effects

| Disease | Cell Type | Representative Culture References | Pathological Features of Aberrant Programming | Pathologic Change Reference |
|---|---|---|---|---|
| ARC/AIDS | hematopoietic | Current protocols in immunology Coligan, et al. (eds.), John Wiley, Inc., N.Y. 1991 | 1) reduction in CD4' lymphocytes and an inversion of the CD4' to CD8' 2) reduction in CD16'CD8'CD3' cells 3) functional de-facts in lymphocytes including: (a) altered responses to certain antigens and mitogens; (b) defact in ability to under-go clonal expansion; (c) abnormalities in IL-2 receptor expression 4) functional defects in other blood cells (a) abnormal TNF production; (b) defective platelet production | 1) Fauci, Sci. 239, 617, 1988. 2) Mansour, et al., AIDS Res. Human Retro. 6, 1451, 1990. 3a) Pinching and Nye, Immunol. Today 11, 256, 1990. 3a) Allouche, et al., Clin. Exp. Imm. 81, 200, 1990. 3b) Pantaleo, et al., J. Immunol. 144, 1696, 1990 3c) Prince, et al., Clin. Exp. Immun. 67, 59, 1987. 4a) Otah, J. Int. Med. 228, 549, 1990. 4b) Zucker-Franklin and Cao, PNAS 86, 5595, 1989. |
| Atherosclerosis | smooth muscle | a) Orekhov, et al., Atherosclerosis 60, 101, 1986. b) Campbell and Campbell, Vascular Smooth Muscle in Culture, Vols. I and II, CRC Press, Boca Raton, FL, 1987. | Shift from contractile to synthetic phenotype. Features of latter include 1) proliferation 2) increased HLA-DR expression 3) loss of muscle proteins 4) growth factor production 5) synthesis of extracellular matrix 6) production of decay-accelarating factor 7) shift from media to intimal location | 1) Olsson (ed) Atherosclerosis: Biology and Clinical Science, Churchill Livingstone, NY 1987. 2) Jonasson, et al., J. Clin. Invest. 76, 125, 1985. 3) Glukhova, et al., PNAS 85, 9542, 1988. 4) Wilcox, et al., J. Clin. Invest. 82, 1134, 1988. 5) Mosse, et al., Lab. Invest. 53, 556, 1985. 6) Seifert and Hansson, J. Clin. Invest. 84, 597, 1989. 7) Betz, et al., J. Cell. Phys. 147, 385, 1991. |

TABLE IV

Representative Tissue Culture References for Primary Normal Human Tissue

| Tissue | Reference |
|---|---|
| Gasterointestinal (and a variety of other epithelial and mesenchymal cell types) | a) Moyer and Gendelman, J. Leuk. Biol. 49, 499, 1991. b) Moyer, J. Tiss. Cult. Meth. 13, 107, 1991. |
| bone marrow | Eaves, et al., J. Tissue Cult. Meth. 13, 55, 1991. |
| hematopoietic stem cells | a) Messner, et al., Blood, 70, 1425, 1987. b) Bernstein, et al., Blood 77, 2316, 1991. c) Caux, et al., Blood 75, 2292, 1990. |
| liver | Gomez-Lechan, et al., In Vitro Cell. Dev. Biol. 26, 67, 1990. |

TABLE V

Effect of p53 a.s. ODNs on in vitro growth of partially purified blasts from peripheral blood of patients with acute non-lymphocytic leukemia. Values represent triplicate cultures from seven separate experiments, a through g, including six different patients at either presentation or relapse. Peripheral blood leukemia blasts were isolated by Ficoll-Hypaque separation and sheep erythrocyte T-cell rosetting. Cells were plated at $5 \times 10^6$/ml in medium as described (*). Control cultures either contained no a.s. ODNs (control) or a.s. ODN to rev (HIV). A.s. ODNs were added 24 hours after plating. In A., aliquots were removed from culture on days 5, 10 and 15 and counted for Trypan blue exclusion. In B., cells were removed on day 10 washed to remove a.s. ODN. replated at $5 \times 10^6$/ml and counted 5 days later (day 15). nd = not done.

A.

| a.s. ODN | | a | | | b | | | c | | | d | |
|---|---|---|---|---|---|---|---|---|---|---|---|---|
| day | 5 | 10 | 15 | 5 | 10 | 15 | 5 | 10 | 15 | 5 | 10 | 15 |
| Control | 100 | 100 | 100 | 100 | 100 | 100 | 100 | 100 | nd | 100 | 100 | 100 |
| HIV | nd | nd | nd | 54 | 55 | 75 | 46 | 45 | nd | 100 | 79 | 89 |
| OL(1) | 88 | 4 | 1 | 0 | 0 | 0 | 22 | 4 | nd | 64 | 21 | 27 |
| A(1) | 51 | 74 | nd | 0 | 0 | 0 | 86 | 21 | nd | 64 | 43 | 29 |
| A(3) | 101 | 15 | 13 | 51 | 18 | 21 | 30 | 2 | nd | 41 | 24 | 24 |
| C(1) | 60 | 57 | 41 | nd | nd | nd | 49 | 15 | nd | 55 | 19 | 17 | percent viable cells of control

B.

percent of control

| a.s. ODN | | e Replated | | | f Replated | | | g Replated | |
|---|---|---|---|---|---|---|---|---|---|
| day | 5 | 10 | 15 | 5 | 10 | 15 | 5 | 10 | 15 |
| Control | 100 | 100 | 100 | 100 | 100 | 100 | 100 | 100 | 100 |
| HIV | 102 | 85 | 103 | 83 | 102 | 92 | 90 | 97 | 91 |
| OL(1) | 68 | 46 | 33 | 45 | 44 | 31 | 45 | 34 | 43 |
| A(1) | 77 | 46 | 37 | 53 | 44 | 71 | 59 | 75 | 64 |
| A(3) | 93 | 55 | 37 | 51 | 57 | 73 | 63 | 51 | 62 |
| C(1) | 72 | 49 | 41 | 53 | 59 | 37 | 66 | 63 | 77 |

* Buick, et al., Blood 54, 95, 1979.

TABLE VI

Effect of p53 a.s. ODNs on in vitro colony formation (CFU-L) of cells removed on either day 0 or 7 of the two of the cultures described in Table V (f and g). Values represent mean ± SD of triplicate cultures. Controls were as described in Table V. Cells were cultured according to B. Lange (*) at $1 \times 10^5$/ml. A fraction of the cells from day 7 colonies were washed and replated at $1 \times 10^5$/ml as described (*) in the absence of a.s. ODN. A colony was defined as >20 cells; day 7 control colonies varied from 70 to 240, day 14 colonies varied from 13 to 55. n.d. = not done.

| a.s. ODN | f replated | | g replated | |
|---|---|---|---|---|
| day | 7 | 14 | 7 | 14 |
| Control | 100 | 100 | 100 | 100 |
| HIV | 87 | 92 | 98 | 82 |
| OL(1) | 17 | 15 | 60 | 2 |
| A(1) | 28 | 138 | 79 | 262 |
| A(3) | 58 | 108 | 96 | 24 |
| C(1) | 23 | 8 | 81 | 4 |

* Lange, et al., Blood 70, 192, 1982.

TABLE VII

Effect of p53 a.s. ODN on in vitro growth of normal bone marrow. Values represent the cumulative mean ± SD of triplicate cultures from three separate experiments. Mononuclear cells were isolated by Ficoll-Hypaque separation. Cells were plated at $2 \times 10^6$/ml in medium as described (*) except for substituting horse for human serum. Control cultures either contained no a.s. ODN, or a.s. ODN to rev (HIV). A.s. ODNs were added 24 hours after plating. Aliquots were removed from culture on days 5 and 10, and counted for Trypan blue exclusion.

| | Viable cells $\times 10^5$ | |
|---|---|---|
| a.s. ODN | day 5 | 10 |
| Control | 12.7 ± 3.3 | 13.1 ± 2.5 |
| HIV | 11.8 ± 2.6 | 11.5 ± 2.2 |
| OL(1) | 12.1 ± 2.6 | 12.0 ± 1.8 |
| A(1) | 11.9 ± 2.1 | 12.2 ± 1.5 |
| A(3) | 12.1 ± 2.7 | 14.5 ± 1.4 |
| C(1) | 9.7 ± 2.0 | 10.9 ± 0.5 |

* Bayever. et al., Exp. Cell Rev. 179, 168, 1988.

TABLE VIII

Effect of p53 a.s. ODNs on in vitro colony formation of hematopoietic progenitors removed on day 7 from three of the normal bone marrow cultures described in Table VI. Values represent the cumulative mean ± SD of triplicate cultures. Controls were as described in Table V. Cells were cultured as described (*), except they were plated at $1 \times 10^6$/ml. A fraction of the cells front day 7 colonies were washed and replated at $5 \times 10^4$/ml for the CFU-Mix and BFU-E, or $1 \times 10^5$/ml for the CFU-GM as described (*). A colony was defined as >20 cells. All colonies were cultured in the absence of a.s. ODNs.

| a.s. ODN | CFU-Mix | BFU-E | CFU-GM |
|---|---|---|---|
| Control | 3.9 ± 4.5 | 4.4 ± 7.2 | 237.6 ± 100.1 |
| HIV | 1.1 ± 0.9 | 1.0 ± 1.0 | 329.1 ± 161.9 |
| OL(1) | 1.8 ± 1.8 | 15.8 ± 1.8 | 278.9 ± 117.9 |
| A(1) | 9.5 ± 6.7 | 11.6 ± 7.8 | 330.3 ± 123.8 |
| A(3) | 1.0 ± 1.0 | 1.3 ± 1.8 | 261.3 ± 90.2 |
| C(1) | 3.4 ± 4.1 | 1.0 ± 1.9 | 254.5 ± 94.9 |

* Messner, et al., Blood 70, 1425, 1987. Caux, et al., Blood 75, 2292, 1990.

TABLE IX

Method for non-human primate peripheral blood T-cell studies:

1. Heparinized blood was diluted by one third with HBSS, layered over Ficoll-Hypaque and centrifuged at 1600 r.p.m., for 40 minutes at 20° C.
2. Interface mononuclear cells were recovered and washed twice with HBSS, resuspended in RPMI 1640 with 10% FCS to $1 \times 10^6$/ml in the presence of PHA (10 µg/ml)
3. Cells were incubated at 37° C. in 5% $CO_2$ for 72 to 96 hours.
4. Cells were harvested, washed and replated at $5 \times 10^5$/ml in medium consisting of RPMI 1640 with 10% FCS and 10% IL-2.
5. After a 24 hour incubation the a.s. ODN was added to the culture at a 10 µM concentration.
6. At 2 to 3 day intervals an aliquot was removed and counted for Trypan blue exclusion.

BMC039-PHA-primed human T-cells Aug. 14, 1991 KMH
PHA stimulated → Day 4 wash + place in IL-2 =
"Day 0", "Day 1" add 10 µM oligo

| | Media | A(1) | Oh(1) | A(3) | C(1) | HIV-2 |
|---|---|---|---|---|---|---|
| Day 0 | $2 \times 10^6$/ml | $2 \times 10^6$/ml | $2 \times 10^6$/ml | $2 \times 10^6$/ml | $2 \times 10^6$/ml | $2 \times 10^6$/ml |
| Day 2 | $8 \times 10^5$ | 3.6 | 5 | 4.2 | 4.2 | 6.8 |
| | 8.2 | 4.4 | 5.2 | 5 | 5 | 7.4 |
| | 7.4 | 3.6 | 4 | 4 | 5.2 | 8.6 |
| | $7.9 \times 10^6$ | $3.9 \times 10^6$ | $4.7 \times 10^6$ | $4.4 \times 10^4$ | $4.8 \times 10^4$ | $7.6 \times 10^6$ |
| Day 4 | $11.2 \times 10^6$ | 7.2 | 5.6 | 4 | 9.2 | 10.6 |
| | 11.4 | 6.6 | 8 | 6 | 8.6 | 10.4 |
| | 10.6 | 8 | 6.2 | 7.2 | 7.8 | 10 |
| | $11.1 \times 10^6$ | $7.3 \times 10^6$ | $6.6 \times 10^6$ | $5.7 \times 10^6$ | $8.5 \times 10^6$ | $10.3 \times 10^6$ |
| Day 7 | $18.2 \times 10^6$ | 7 | 8.8 | 2.3 | 9.2 | 15.4 |
| | 19.6 | 7.4 | 6.6 | 10.4 | 2.0.8 | 14.2 |
| | 18.6 | 8.2 | 9.8 | 2.1.2 | 2.1.6 | 14.6 |
| | $18.9 \times 10^6$ | $7.5 \times 10^6$ | $8.4 \times 10^6$ | $11.5 \times 10^6$ | $10.5 \times 10^6$ | $14.7 \times 10^6$ |
| | $6.3 \times 10^6$ | 6.6 | 6.5 | 6.2. | 6.5 | 6.1 |
| Day 9 | $7.1 \times 10^6$ | 6.6 | 6.8 | 6.9 | 6.9 | 6.7 |

BMC028 - 2 samples of monkey PB Aug. 14, 1991 KMH
PHA prime → onto IL-2, then oligo

| | Media | A(1) | Oh(1) | A(3) | C(1) | HIV-2 |
|---|---|---|---|---|---|---|
| Day 0 | $2 \times 10^6$/ml | $2 \times 10^6$/ml | $2 \times 10^6$/ml | $2 \times 10^6$/ml | $2 \times 10^6$/ml | $2 \times 10^6$/ml |
| Day 1 | | 10 µM oligo | 10 µM oligo | 10 µM oligo | 10 µM oligo | 10 µM oligo |
| Day 4 | | | | | | |
| Primate A | $1.0 \times 10^6$ | 0.6 | 0.47 | 0.33 | 0.53 | 1.2 |
| | 1.13 | 0.47 | 0.47 | 0.27 | 0.4 | 1.0 |
| | $1.07 \times 10^6$ | $0.53 \times 10^5$ | $0.47 \times 10^5$ | $0.3 \times 10^5$ | $0.47 \times 10^5$ | $1.1 \times 10^6$ |
| Primate B | $1.93 \times 10^6$ | 1.67 | 0.67 | 0.73 | 0.53 | $1.6 \times 10^6$ |
| Day 6 | | | | | | |
| Primate A | $2.0 \times 10^6$ | 1.4 | 1.07 | 1.33 | 1.4 | 3.2 |
| | 2.93 | 1.2 | 1.33 | 1.07 | 1.2 | 2.67 |
| | $2.47 \times 10^6$ | $1.33 \times 10^6$ | $1.2 \times 10^6$ | $1.2 \times 10^6$ | $1.33 \times 10^6$ | $2.93 \times 10^6$ |
| Primate B | $2.2 \times 10^6$ | $1.2 \times 10^6$ | $0.7 \times 10^6$ | $1 \times 10^6$ | $0.8 \times 10^6$ | $2.3 \times 10^6$ |

TABLE IX-continued

Method for non-human primate peripheral blood T-cell studies:

Day 8
bacteria in A

| Primate B | $2.9 \times 10^6$ | $1 \times 10^6$ | $0.4 \times 10^6$ | $0.7 \times 10^6$ | $1.2 \times 10^6$ | $2.4 \times 10^6$ |

Day 10
bacteria emerging in B

On "Day 4" cells were removed, washed free of oligo and replated at $2 \times 10^6$/ml. Replated cells → single cells → * (Day 4 = $2 \times 10^6$/each)

TABLE X

Therapeutic Association of Gene Targets for which "Hotspots" and Prototype Antisense Oligonucleotides have been Disclosed Herein

| Gene Targets | Therapeutic Association |
|---|---|
| androgen receptor; AP-2,4; ATF genes; BSAP; C/EBP; C/EBPα,β; CDK genes; CHF.10,12; CREB α,β,δ,γ; CREBPa,1; CREM; CTF/NF1; cyclin genes; DB1; DP-1; E12; E2A; E2F-1,2,3,4; E2F-like protein; E4BP4; E4TF1; E47; Elk-1,2; Erg-1,2; Erk-1,2,3; ERM; EVX-1,2; estrogen receptor; c-fos; fra-1,2; gadd genes; Gata1,2,3,4; HB9; HB24; HLX-1; hox genes; h-plk; HS1; HTF4; Id-1,2,3; IRF-1,2; ISGF3; jun genes; Lyl-1; MAD genes; MADS; max genes; MSX1,2; MTF-1; Mxi-1; myb genes; myc genes; Mzf-1; Net; NF-ATc; NF-IL6β; NF-kβ; NF-kβ-2; Oct1,2,3,6; Oct-T1,2; OTF3, 3c; OZF; p53; p107; Rb; RBAP-1; RBP1,2; Ref-1; rel genes; SAP-1,2; Sp1,2,3,4; SCL; Spi-1,B; SRF; TR3,4; USF; WT-1; YY1. | AP Diseases, where potential targets are selected according to the AP model; reprogramming normal cells; suppressing virus expression and/or effects of virus on cells; suppressing and/or enhancing expression of particular host genes of clinical significance. |
| 5-alpha reductase | Cancer |
| β-amyloid precursor protein | Alzheimer's |
| Apolipoprotein B | Atherosclerosis; Chronic renal disease |
| Apolipoprotein epsilon 4 | Alzheimer's |
| CDK2, CDK5 | Alzheimer's |
| Cyclooxygenase-1,2 | Inflammation |
| Dopamine D-1,2 receptors | Schizophrenia |
| Epidermal growth factor receptor | Cancer |
| bFGF | Alzheimer's; Cancer; Rheumatoid Arthritis |
| FLT-1 | Cancer; Psoriasis; Rheumatoid Arthritis |
| FLT-3; FLT-4 | Cancer |
| FLT-3/FLK2(STk-1) | Inhibit proliferation of normal hematopoietic stem cells; e.g., to protect from chemotherapy |
| GADD genes | Destruction of cells subjected to DNA damaging agents; e.g., irradiation, or viral infection; and reverse of proliferation arrest of cells subjected to oxidative damage, such as, e.g., AIDS and ARC |
| hgp$_x$1 | Atherosclerosis; Cancer |
| HSP27 | Alzheimer's, Cancer |
| 5-HT$_2$ receptor | Schizophrenia |
| KDR/FLK-1 | Cancer; Rheumatoid Arthritis |
| MTS-1,2 | AIDS; ARC; Cancer; Expansion of proliferating normal cell populations |
| p34cdc2 | Cancer; Inhibiting normal cell growth |
| Pim-1 | Cancer |
| PKC genes | AIDS; Alzheimer's; ARC; Atherosclerosis; Cancer; Restenosis |
| Platelet-derived endothelial growth factor | Cancer; Rheumatoid Arthritis |
| Platelet-derived growth factor | Cancer; Atherosclerosis; Renal disease |
| Platelet-derived growth factor receptor | Cancer; Atherosclerosis; Renal disease |
| Prostaglandin endoperoxide synthase | Inflammation |
| Ref-1 | Cancer |
| TGFα,β | AIDS; Cancer; Inflammatory diseases; Psoriasis; Renal disease; Restenosis; Schizophrenia |
| TNFα | Multiple Sclerosis; Multiple-Systems Organ Failure Syndrome; Rheumatoid Arthritis; Toxic Shock Syndrome |
| TNFβ | Cancer; Inflammatory diseases; Multiple sclerosis |
| TRPM-2 | Alzheimer's |
| Vascular Endothelial Growth Factor | Cancer; Psoriasis; Rheumatoid arthritis |
| Waf-1 | AIDS; ARC; activate CDK genes; normal expansion of proliferating cell populations |

TABLE XI

Genes/Proteins (Other than Transcriptional Regulators) Implicated in the Regulation of Apoptosis

| | |
|---|---|
| Androgens | glucocorticoids |
| Apo-1 | growth factors |
| Bax a,b,g | Heat Shock Protein |
| bcl-2 | ICE |
| bcl-x | ICH-1L |
| bcl-xl | ICH-1S |
| bcl-xs | Mcl-1 |
| CD40 ligand | Neurotransmitters |
| cyclins | SGP-2 |
| DAD1 | TGF family |
| estrogen | TNF family |
| extracellular matrix | TRPM-2 |

TABLE XII

Medical Conditions/Diseases in Which Apoptosis is Implicated

AIDS
Alzheimer's disease
Amyotrophic lateral sclerosis
Atherosclerosis/restenosis
Cerebellar degeneration
Cancer
Glomerulonephritis, immune-mediated
Liver disease, toxin-induced
Multiple organ dysfunction syndrome
Multiple sclerosis
Myelodysplastic syndromes
Myocardial infarction
Parkinson's disease
Prostatic hyperplasia, benign
Reperfusion injury
Retinitis pigmentosa
Rheumatoid arthritis
Stroke
Systemic lupus erythematosis
Ulcerative colitis
Viral infections:

adenoviruses
cytomegaloviruses (CMV)
Epstein-Barr virus (EBV)
hepatitis C virus
herpesviruses
hemorrhagic fever viruses
human Immunodeficiency viruses (HIV)
influenza viruses
poxviruses
vaccinia viruses

TABLE XIII

Aberrant Programming Disease Models

AIDS (1) In vivo
        a) Yeung et al., J Exp Med 180: 1911, 1994
        b) Barnett et al., Science 266: 642, 1994
        c) Fultz, Clin Infect Dis 17 (Suppl 1): S230, 1993
        d) Livartowski et al., Cancer Detect Prevention 16: 341, 1992
    (2) In vitro
        a) Asmuth et al., AIDS 8: 205, 1994
        b) Truckenmiller et al., AIDS Res Hum Retroviruses 9: 445, 1993
        c) Fauci, Lymphokine Res 9: 527, 1990
        d) Lori et al., Science 266: 801, 1994

Alzheimer's Disease (1) Animal models reviewed:
        a) Myhrer, Neurosci Biobehavior Res 17: 195, 1993
        b) Anger, Neurotoxicology 12: 403, 1991
    (2) In vitro
        a) Adler et al., Proc Natl Acad Sci USA 88: 16, 1991
        b) Yoshikawa et al., Nature 359: 64, 1992
        c) Blass et al., J. Neurol Sci 121: 132, 1994
        d) Matsumoto, Biochim Biophys Acta 1225: 304, 1994
        e) Wainer et al., Adv Exp Med Biol 295: 415, 1991
        f) Altstiel and Sperber, Prog Neuropsychopharm Biol Psychiatry 15: 481, 1991
        g) Busciglio et al., J Neurochem 61: 1565, 1993

Atherosclerosis (1) In vivo
        a) Kappel et al., FASEB J 8: 583, 1994
        b) Fekete, Acta Vet Hung 41: 3, 1993
        c) Williams et al., Arch Pathol Lab Med 115: 784, 1991
    (2) In vitro
        a) Roth et al., Coron Artery Dis 4: 283: 1993
        b) Shrivastava et al., Methods Findings Exp Clin Pharmacol 15: 345, 1993

TABLE XIII-continued

Aberrant Programming Disease Models c) Graham et al., J Invest Surg 4: 487, 1991
        d) Couffinhal et al., Circ Res 74: 225, 1994
        e) Bjorkerud et al., Arterioscler Thromb 14: 644, 1994
        f) Babaev et al., Atherosclerosis 96: 189, 1992
        g) Pickering et al., J Amer Coll Cardiol 20: 1430, 1992
        h) Parkes et al., Amer J Pathol 138: 765, 1991

Cancer (1) In vivo
        a) Manzotti et al., Clin Exp Metastasis 11: 5, 1993
        b) Mule et al., J Immunother 12: 196, 1992
    (2) In vitro
        a) Hoffman, Cancer Cells 3: 86, 1991
        b) Moore and Minowada, Human Cell 5: 313, 1992
        c) Parchment et al., Int J Cell Cloning 10: 359, 1992
        d) Parkins and Steel, Brit J Cancer 62: 935, 1990
        e) Marshall et al., Stem Cells Dayt 11: 62, 1993
        f) Hanauske et al., Anticancer Drugs 3: 121, 1992
        g) Foulke et al., Cancer Res 50: 6264, 1990

Rheumatoid Arthritis (1) In vivo
        a) Plater-Zyberk et al., Clin Exp Immunol 98: 442, 1994
        b) Geiler et al, Arthritis Rheum 37: 1664, 1994
        c) Durie et al., Clin Immunol Immunopathol 73: 11, 1994
    (2) In vitro
        a) Partsch et al., Scand J Rheumatol 20: 98, 1991
        b) Johnstone et al., Autoimmunity 10: 35, 1991
        c) Sadouk et al., Clin Immunol Immunopathol 56: 37, 1990
        d) Goddard et al., Cytokine 2: 149, 1990

Schizophrenia (1) In vivo
        a) Okuyama et al., Life Sci 55: PL133, 1994
        b) Swerdlow et al., Arch Gen Psychiatry 51: 139, 1994
        c) Zhang et al., J Pharmacol Exp Ther 271: 1462, 1994
        d) Silvia et al., Mol Pharmacol 46: 51, 1994
        e) Zhou et al., J Pharmacol Exp Ther 268: 1015, 1994
        f) Zhang and Creese, Neurosci Lett 161: 223, 1993
        g) Weiss B et al., Neurosci 55: 607, 1993
    (2) In vitro
        a) Taylor et al., NIDA-Res-Monogr 133: 125, 1993
        b) Normal et al., J Med Chem 37: 2552, 1994

TABLE XIV

MDR-ODNs

| Oligo Name | 5'-end target site[1] | Oligo length (No. of bases) | Why the site was selected (Footnote #) | Relative Activity |
|---|---|---|---|---|
| OL(1)mdr | 1125[1] | 20 | 2 | +++ |
| OL(1A)mdr | 1122 | 20 | variant | ++ |
| OL(1B)mdr | 1123 | 22 | variant | ++++++ |
| OL(1C)mdr | 1125 | 25 | variant | +++++++ |
| OL(1Q)mdr | 1125 | 23 | variant | ++++++ |
| OL(1W)mdr | 1125 | 18 | variant | +++++ |
| OL(1Wa)mdr | 1123 | 18 | variant | ++++ |
| OL(1Wb)mdr | 1125 | 16 | variant | ++++ |
| OL(1Wc)mdr | 1121 | 18 | variant | ++++ |
| OL(1X)mdr | 1127 | 18 | variant | +++ |
| OL(2)mdr | 1688 | 20 | 2 | + |
| OL(3)mdr | 5996 | 20 | 2 | + |
| OL(5)mdr | 1000 | 20 | 2 | +++ |
| OL(6)mdr | 488 | 20 | 3 | + |
| OL(6A)mdr | 496 | 20 | variant | — |
| OL(7)mdr | 2199 | 20 | 3 | + |
| OL(8)mdr | 5722 | 20 | 3 | — |
| OL(9)mdr | 3881 | 20 | 2 | — |
| OL(10)mdr | 688 | 20 | 3 | +++ |
| OL(11)mdr | 851 | 20 | 3 | + |
| OL(12)mdr | 884 | 20 | 3 | +++ |

TABLE XIV-continued

MDR-ODNs

| Oligo Name | 5'-end target site[1] | Oligo length (No. of bases) | Why the site was selected (Footnote #) | Relative Activity |
|---|---|---|---|---|
| OL(12A)mdr | 881 | 22 | variant | +++++ |
| OL(12B)mdr | 885 | 18 | variant | +++ |
| OL(12C)mdr | 881 | 18 | variant | ++ |
| OL(13)mdr | 958 | 20 | 3 | — |
| OL(14)mdr | 5713 | 20 | 3 | — |
| OL(15)mdr | 941 | 20 | 3 | — |
| OL(16)mdr | 517 | 20 | 2 | + |
| SJ(1)mdr | 85 | 20 | splice junction | — |
| SJ(2)mdr | 673 | 20 | splice junction | ++ |
| SJ(6)mdr | 2559 | 20 | splice junction | + |
| SJ(18)mdr | 6074 | 20 | splice junction | + |
| SJ(30)mdr | 4867 | 20 | splice junction | — |
| SJ(33)mdr | 349 | 20 | splice junction | — |
| SJ(34)mdr | 540 | 20 | splice junction | +++ |
| SJ(34A)mdr | 542 | 18 | variant | +++++ |
| SJ(34B)mdr | 540 | 22 | variant | ++ |
| SJ(34C)mdr | 533 | 20 | variant | + |
| SJ(34D)mdr | 543 | 16 | variant | + |
| SJ(35)mdr | 1097 | 20 | splice junction | — |
| SJ(36)mdr | 6551 | 22 | splice junction | + |
| 3(1)mdr | 7051 | 20 | 3'-end | — |
| 5(1)mdr | 664 | 26 | 4, AUG start | ++ |
| 5(2)mdr | 640 | 28 | 4 | — |
| AP(1)mdr | 670 | 23 | 5; TR binding | + |
| AP(4)mdr | 636 | 22 | 5; TR binding | + |
| PA(1)mdr | — | 23 | reverse of AP(1) | + |
| TH(2)mdr | 2954 | 20 | published | + |
| CAP(2)mdr | 556 | 22 | cap site | + |
| LOW(3)mdr | 11 | 20 | low Tm | + |
| Cohen(1)mdr | 1130 | 15 | published | + |
| NF-kB(1)mdr | 296 | 22 | 5; TR binding | — |
| CAT(L)mdr | 432 | 20 | TR binding | — |
| Y-box-mdr | 464 | 22 | TR binding | — |

Reactivity: — = no effect; + = weak positive effect; +++++++ = very strong positive effect.
The relative reactivity indicated for each MDR-ODN summarizes results obtained with 8226/Dox4, 8226/Dox6 and CEM/Vlb10 multidrug-resistant cell lines.
1 The numbering for the 5'-end target site is based on Genbank entry HUMMDR1A01-through-HUMMDR1A26 (Chin et al., Mol. Cell. Biol. 9: 3808, 1989; Chen et al., J. Biol. Chem. 265: 506, 1990), considered as a continuous sequence with the nucleotide at the extreme 5'-end of the sequence being given the nucleotide base number 1.
2 The preferred prototype ODNs were selected using the secondary selection method, as described in the text of the Specification.
3 The "alternative" prototype ODNs are secondary sites that were selected manually.
4 These ODNs were designed to have sufficient binding affinity to the 5'-untranslated portion of the cDNA to potentially block the movement of the ribosome toward the AUG start site.
5 Binding sites of these oligos are within an enhancer for the MDR1 gene, the sequence of which is reported by Kohno et al., J. Biol. Chem. 265: 19690, 1990. (GenBank entry # HUMMDR1B/J05674).

TABLE XV

MRP-ODNs

| Oligo Name | 5'-end target site[1] | ODN length (No. of bases) | Why the site was selected (Footnote #) | Relative Activity |
|---|---|---|---|---|
| A(1)MRP | 194[1] | 20 | AUG start site | — |
| OL(2)MRP | 2114 | 20 | 3 | — |
| OL(3)MRP | 2848 | 20 | 2 | +++ |
| OL(4)MRP | 4154 | 20 | 3 | — |
| OL(5)MRP | 1210 | 20 | 3 | — |
| OL(6)MRP | 2516 | 20 | 3 | + |
| OL(7)MRP | 3155 | 20 | 3 | — |
| OL(8)MRP | 3539 | 20 | 2 | +++++ |
| OL(9)MRP | 3800 | 20 | 2 | + |
| OL(10)MRP | 4484 | 20 | 3 | ++ |
| OL(11)MRP | 4715 | 20 | 3 | — |
| OL(12)MRP | 89 | 20 | 3 | — |
| OL(13)MRP | 129 | 20 | 3 | — |
| OL(14)MRP | 220 | 20 | 3 | + |
| OL(15)MRP | 3312 | 20 | 3 | — |
| OL(16)MRP | 1580 | 20 | 3 | — |
| 3(2)MRP | 4836 | 20 | 3' end | — |
| 3(3)MRP | 4933 | 20 | 3' end | — |
| 5(2)MRP | 164 | 26 | 4 | +++ |
| 5(3)MRP | 24 | 26 | 4 | ++ |
| LOW(1)MRP | 351 | 20 | low $T_m$ | — |
| LOW(2)MRP | 714 | 20 | low $T_m$ | + |
| CAP(2)MRP | 1 | 19 | Cap site | + |

Reactivity: — = no effect; + = weak positive effect; +++++ = strong positive effect
1 The numbering for the 5'-end target site is based on Genbank entry HUM-MRPX/L05628 (Cole et al., Science 258: 1650, 1992) with the nucleotide at the extreme 5'-end of the sequence being given the nucleotide base number 1.
2 The preferred prototype ODNs were selected using the secondary selection method, as described in the text of the Specification
3 The "alternative" prototype ODNs are secondary sites that were selected manually.
4 These ODNs were designed to have sufficient binding affinity to the 5'-untranslated portion of the cDNA to potentially block the movement of the ribosome toward the AUG start site.

TABLE XVI

Sensitization of 8226/Dox4 myeloma cells to vincristine by the most active of the MDR-ODNs

| Oligonucleotide (Trivial Name) | Estimated Mean 3H-TdR Count (VCR dose = 0) (Method 1) | Estimated $IC_{50}$ (Method 1) | Fold Increase in Drug Sensitivity (Method 1) | Estimated $IC_{50}$ (Method 2) | Fold Increase In Drug Sensitivity (Method 2) |
|---|---|---|---|---|---|
| Media only | 159,500 | $1.28 \times 10^{-5}$M | — | $1.2 \times 10^{-5}$M | — |
| OL(1B)mdr | 120,800 | $1.79 \times 10^{-8}$M | 715 | $1.9 \times 10^{-9}$M | 6,315 |
| OL(1Q)mdr | 76,200 | $1.92 \times 10^{-8}$M | 667 | $<1 \times 10^{-10}$M | >120,000 |
| OL(12A)mdr | 159,500 | $2.97 \times 10^{-8}$M | 414 | $3.2 \times 10^{-8}$M | 375 |
| OL(12)mdr | 159,500 | $5.5 \times 10^{-8}$M | 233 | $6.0 \times 10^{-8}$M | 200 |
| SJ(34A)mdr | 100,300 | $6.81 \times 10^{-8}$M | 188 | $<1 \times 10^{-10}$M | >120,000 |

TABLE XVI-continued

Sensitization of 8226/Dox4 myeloma cells to vincristine by the most active of the MDR-ODNs

| Oligonucleotide (Trivial Name) | Estimated Mean 3H-TdR Count (VCR dose = 0) (Method 1) | Estimated $IC_{50}$ (Method 1) | Fold Increase in Drug Sensitivity (Method 1) | Estimated $IC_{50}$ (Method 2) | Fold Increase In Drug Sensitivity (Method 2) |
|---|---|---|---|---|---|
| OL(1C)mdr | 40,200 | $1.33 \times 10^{-7}$M | 97 | $<1 \times 10^{-10}$M | >120,000 |
| OL(12B)mdr | 159,500 | $7.39 \times 10^{-7}$M | 17 | $6.8 \times 10^{-7}$M | 18 |

METHOD 1: Based on parsimonious mathematical model fitting all the data for each MDR-ODN and the media control. According to this model, the log of the tritiated thymide (3H-TdR) uptake count is modelled as a linear function of powers of drug dose. Given the estimate of the parameters, one can compute the dose of drug required to produce an expected 3H-TdR uptake count equal to one-half that expected in the absence of drug (50% inhibitory concentration, or "IC50") but in the presence of the specific MDR-ODN used in the experimental groups. The fit with the experimental data is excellent ($R^2 > 0.99$). Hence, these values express the ability of a particular MDR-ODN to sensitize the multidrug resistant cancer cells to the drug independently of any effect the MDR-ODN used without drug might have on the cells.

METHOD 2: The data were plotted on graphs in which the X-axis was the log of the concentration of drug used in a given experiment group, while the Y-axis was "% Media Control" plotted on a linear scale, where $$\% \text{ media control} = \frac{\text{3H-TdR count for particular MDR-ODN and concentration of drug}}{\text{3H-TdR count for cells treated with same concentration of drug, but in absence of MDR-ODN}}$$

A line parallel to the X-axis is then drawn at the 50% media control value. A vertical line through the point at which this line intersects each of the (MDR-ODN + drug-dose) response curves indicates the drug IC50 value on the X-axis for that MDR-ODN.

TABLE XVII

Effects of junD, MDR- and MRP-ODNs on drug sensitivity of drug-resistant and drug-sensitive human tumor cell lines

| Oligonucleotide (Trivial Name) | Human Tumor Cell Line | Drug Activity ($IC_{50}$) | Fold increase in Drug Sensitivity |
|---|---|---|---|
| Media Control | 8226/Dox6 | $1.2 \times 10^{-5}$M | — |
| H(2)junD | " | $1.1 \times 10^{-8}$M | 1091 |
| H(1)junD | " | $2.4 \times 10^{-8}$M | 500 |
| OL(1C)mdr | " | $6.3 \times 10^{-8}$M | 190 |
| SJ(34A)mdr | " | $2.3 \times 10^{-7}$M | 52 |
| OL(12A)mdr | " | $3.1 \times 10^{-7}$M | 39 |
| reverse-H(1)junD | " | $1.9 \times 10^{-5}$M | 0 |
| Media Control | 8226/sensitive | $2.0 \times 10^{-9}$M | — |
| H(1)junD | " | $7.2 \times 10^{-10}$M | 3 |
| OL(1C)mdr | " | $2.3 \times 10^{-9}$M | 0 |
| SJ(34A)mdr | " | $1.9 \times 10^{-9}$M | 0 |
| OL(8)MRP | " | $1.5 \times 10^{-9}$M | 0 |
| Media Control | DU-145 | $3.5 \times 10^{-9}$M | — |
| H(1)junD | " | $1.8 \times 10^{-8}$M | 19 |
| OL(1C)mdr | " | $3.6 \times 10^{-9}$M | 0 |
| SJ(34A)mdr | " | $3.5 \times 10^{-9}$M | 0 |
| OL(8)MRP | " | $2.1 \times 10^{-8}$M | 17 |

8226/Sensitive = drug-sensitive parent cell line, human myeloma tumor (RPMI 8226; ATCC #CCL-155)
8226/Dox6 = multidrug-resistant variant of 8226/S, over-expressing MDR1, and resistant in vitro to $6 \times 10^{-8}$M doxorubicin
DU-145 = multidrug-resistant human prostate cancer cell line, over-expressing the MRP gene Lengthy table referenced here

US07517644-20090414-T00001

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US07517644B1). An electronic copy of the table will also be available from the USPTO upon request and payment of the fee set forth in 37 CFR 1.19(b)(3).

SEQUENCE LISTING (3601 sequences)

SEQ ID NO: 1 - DNA, 20 bp, Homo sapiens
agtcttgagcacatgggagg

SEQ ID NO: 2 - DNA, 20 bp, Homo sapiens
atctgactgcggctcctcca

SEQ ID NO: 3 - DNA, 20 bp, Homo sapiens
gacagcatcaaatcatccat

SEQ ID NO: 4 - DNA, 20 bp, Homo sapiens
ccctgctcccccctggctcc

SEQ ID NO: 5 - DNA, 16 bp, Homo sapiens
gtcggcgtggtggtga

SEQ ID NO: 6 - DNA, 20 bp, Homo sapiens
gctcgtcggcgtggtggtga

SEQ ID NO: 7 - DNA, 32 bp, Homo sapiens
cgtgccgggccggtttctgcgtgctgcgtgcg

SEQ ID NO: 8 - DNA, 22 bp, Homo sapiens
cggtttctgcgtgctgcgtgcg

SEQ ID NO: 9 - DNA, 22 bp, Homo sapiens
tggcgggccggtttctgcgtgc

SEQ ID NO: 10 - DNA, 24 bp, Homo sapiens
ggtccccaaaggtccccgaaagga

SEQ ID NO: 11 - DNA, 23 bp, Homo sapiens
ggtccccaaaggtccccgaaagg

SEQ ID NO: 12 - DNA, 38 bp, Homo sapiens
agctgttcgctgttttccctgtcacgccgcttttctga

SEQ ID NO: 13 - DNA, 22 bp, Homo sapiens
cgctgttttccctgtcacgccg

SEQ ID NO: 14 - DNA, 40 bp, Homo sapiens
cgctcctccgccacccccgtcgccgttgccatcgccaggg

SEQ ID NO: 15 - DNA, 22 bp, Homo sapiens
ccccgtcgccgttgccatcgcc

SEQ ID NO: 16 - DNA, 24 bp, Homo sapiens
gctcctccgccacccccgtcgccg

SEQ ID NO: 17 - DNA, 22 bp, Homo sapiens
ggaaggaggctaccccgagatc

SEQ ID NO: 18 - DNA, 39 bp, Homo sapiens
ggaggatggcgccgagggtggtggaaagcgcggcgaggc

SEQ ID NO: 19 - DNA, 23 bp, Homo sapiens
cgagggtggtggaaagcgcggcg

SEQ ID NO: 20 - DNA, 23 bp, Homo sapiens
tggcgccgagggtggtggaaagc

SEQ ID NO: 21 - DNA, 38 bp, Homo sapiens
gggtcggcggctccagcaacagcagcggccggaggacg

SEQ ID NO: 22 - DNA, 22 bp, Homo sapiens
caacagcagcggccggaggacg

SEQ ID NO: 23 - DNA, 23 bp, Homo sapiens
cggcggctccagcaacagcagcg

SEQ ID NO: 24 - DNA, 30 bp, Homo sapiens
gctctgcgcacgcgcggcttcaggctgtcc

SEQ ID NO: 25 - DNA, 22 bp, Homo sapiens
ctgcgcacgcgcggcttcaggc

SEQ ID NO: 26 - DNA, 34 bp, Homo sapiens
ccgcggcgggcaacatatagggcggcggcgcggg

SEQ ID NO: 27 - DNA, 22 bp, Homo sapiens
acatatagggcggcggcgcggg

SEQ ID NO: 28 - DNA, 26 bp, Homo sapiens
cctgtggctgggcagcgcgtggcggc

SEQ ID NO: 29 - DNA, 22 bp, Homo sapiens
tggctgggcagcgcgtggcggc

SEQ ID NO: 30 - DNA, 32 bp, Homo sapiens
ggagaggacgccgggccgggagtagggtaggg

SEQ ID NO: 31 - DNA, 22 bp, Homo sapiens
ggacgccgggccgggagtaggg

SEQ ID NO: 32 - DNA, 29 bp, Homo sapiens
aggctttcctcctcgcatcagaaacgggt

SEQ ID NO: 33 - DNA, 24 bp, Homo sapiens
tttcctcctcgcatcagaaacggg

SEQ ID NO: 34 - DNA, 34 bp, Homo sapiens
caacagtggcataggctttcctcctcgcatcaga

SEQ ID NO: 35 - DNA, 23 bp, Homo sapiens
tggcataggctttcctcctcgca

SEQ ID NO: 36 - DNA, 33 bp, Homo sapiens
gaacaaggcggagttcactgctgtggacactca

SEQ ID NO: 37 - DNA, 24 bp, Homo sapiens
caaggcggagttcactgctgtgga

SEQ ID NO: 38 - DNA, 33 bp, Homo sapiens
aaatttcactacgagccccagcctgactgaact

SEQ ID NO: 39 - DNA, 25 bp, Homo sapiens
tcactacgagccccagcctgactga

SEQ ID NO: 40 - DNA, 26 bp, Homo sapiens
gccagggcatagccacaccactccat

SEQ ID NO: 41 - DNA, 25 bp, Homo sapiens
gccagggcatagccacaccactcca

SEQ ID NO: 42 - DNA, 50 bp, Homo sapiens
aacaaaacgtgaagaaagcaaaagccgcgccttggacagaccagctggcc

SEQ ID NO: 43 - DNA, 22 bp, Homo sapiens
gccgcgccttggacagaccagc

SEQ ID NO: 44 - DNA, 23 bp, Homo sapiens
aagcaaaagccgcgccttggaca

SEQ ID NO: 45 - DNA, 23 bp, Homo sapiens
cgtgaagaaagcaaaagccgcgc

SEQ ID NO: 46 - DNA, 32 bp, Homo sapiens
tcaatgagccatccctaagttcgctgcctggg

SEQ ID NO: 47 - DNA, 22 bp, Homo sapiens
gccatccctaagttcgctgcct

SEQ ID NO: 48 - DNA, 34 bp, Homo sapiens
gctggagcttgcgccgccctccgtccagaaaatg

SEQ ID NO: 49 - DNA, 22 bp, Homo sapiens
gcttgcgccgccctccgtccag

SEQ ID NO: 50 - DNA, 32 bp, Homo sapiens
tccgccgcgagccctgccccaacaccccctct

SEQ ID NO: 51 - DNA, 22 bp, Homo sapiens
gcgagccctgccccaacacccc

SEQ ID NO: 52 - DNA, 24 bp, Homo sapiens
tgctcccgcaccacgcccagcagg

SEQ ID NO: 53 - DNA, 22 bp, Homo sapiens
ctcccgcaccacgcccagcagg

SEQ ID NO: 54 - DNA, 31 bp, Homo sapiens
ccccacctagccacccaccccaccccatcca

SEQ ID NO: 55 - DNA, 22 bp, Homo sapiens
gccacccaccccaccccatcca

SEQ ID NO: 56 - DNA, 31 bp, Homo sapiens
agccagctccgaaacccgaaatccgcctccg

SEQ ID NO: 57 - DNA, 22 bp, Homo sapiens
cgaaacccgaaatccgcctccg

SEQ ID NO: 58 - DNA, 24 bp, Homo sapiens
gccactcccgcctgacgcccccca

SEQ ID NO: 59 - DNA, 22 bp, Homo sapiens
gccactcccgcctgacgccccc

SEQ ID NO: 60 - DNA, 29 bp, Homo sapiens
agtctgggactcgggactcgggctgcgcc

SEQ ID NO: 61 - DNA, 22 bp, Homo sapiens
gggactcgggactcgggctgcg

SEQ ID NO: 62 - DNA, 41 bp, Homo sapiens
ggagnnnagccccgncccagcccccacccagacggacccga

SEQ ID NO: 63 - DNA, 22 bp, Homo sapiens
gcccccacccagacggacccga

SEQ ID NO: 64 - DNA, 46 bp, Homo sapiens
aaaaaacaagnaagcctggagcgcccgtctacnccgccgcccgagc

SEQ ID NO: 65 - DNA, 22 bp, Homo sapiens
cgcccgtctacnccgccgcccg

SEQ ID NO: 66 - DNA, 32 bp, Homo sapiens
gcaaccgtgccgtgggcttgctggtgccgtcg

SEQ ID NO: 67 - DNA, 22 bp, Homo sapiens
tgccgtcccgttgctggtgccg

SEQ ID NO: 68 - DNA, 30 bp, Homo sapiens
cctgggtgctgcggctgcggctgggcgtgc

SEQ ID NO: 69 - DNA, 22 bp, Homo sapiens
ctgcggctgcggctgggcgtgc

SEQ ID NO: 70 - DNA, 29 bp, Homo sapiens
ggatcacccccaaatcctgcccgaccccg

SEQ ID NO: 71 - DNA, 22 bp, Homo sapiens
ccccaaatcctgcccgaccccg

SEQ ID NO: 72 - DNA, 39 bp, Homo sapiens
tggctctacgctcttctccccgccccctttccttcccgc

SEQ ID NO: 73 - DNA, 22 bp, Homo sapiens
ccccgccccctttccttcccgc

SEQ ID NO: 74 - DNA, 23 bp, Homo sapiens
gcnccgcatcgcccgctcccccg

SEQ ID NO: 75 - DNA, 20 bp, Homo sapiens
ccgcatcgcccgctcccccg

SEQ ID NO: 76 - DNA, 33 bp, Homo sapiens
gcggcggcggcggcagcagcagcagcagtagca

SEQ ID NO: 77 - DNA, 22 bp, Homo sapiens
cggcggcagcagcagcagcagt

SEQ ID NO: 78 - DNA, 27 bp, Homo sapiens
gggacccaagggcagcggcggcggcgg

SEQ ID NO: 79 - DNA, 22 bp, Homo sapiens
gggacccaagggcagcggcggc

SEQ ID NO: 80 - DNA, 25 bp, Homo sapiens
ccacccctgggccccgagcgcttgg

SEQ ID NO: 81 - DNA, 22 bp, Homo sapiens
ccacccctgggccccgagcgct

SEQ ID NO: 82 - DNA, 43 bp, Homo sapiens
gcctctgcgaaagtgaaatgcccaagcctcgcgcaaagcccag

SEQ ID NO: 83 - DNA, 22 bp, Homo sapiens
gcccaagcctcgcgcaaagccc

SEQ ID NO: 84 - DNA, 22 bp, Homo sapiens
cccgttcccgttggctggccgc

SEQ ID NO: 85 - DNA, 41 bp, Homo sapiens
cgatctcccgccgaatccgccgctcctggtcccgctgagtc

SEQ ID NO: 86 - DNA, 22 bp, Homo sapiens
ccgccgctcctggtcccgctga

SEQ ID NO: 87 - DNA, 22 bp, Homo sapiens
ccgccgaatccgccgctcctgg

SEQ ID NO: 88 - DNA, 41 bp, Homo sapiens
gcctatgccttcgtccttgtcctctgcccgccgtcgcttgg

SEQ ID NO: 89 - DNA, 22 bp, Homo sapiens
tcctctgcccgccgtcgcttgg

SEQ ID NO: 90 - DNA, 50 bp, Homo sapiens
cgcagctcaatcatctcccgccgcaggtcctccgccttctcgtcctccca

SEQ ID NO: 91 - DNA, 22 bp, Homo sapiens
tcccgccgcaggtcctccgcct

SEQ ID NO: 92 - DNA, 23 bp, Homo sapiens
tcctccgccttctcgtcctccca

SEQ ID NO: 93 - DNA, 38 bp, Homo sapiens
attgatgtggtgggagggaggaggaggcggtgctggca

SEQ ID NO: 94 - DNA, 22 bp, Homo sapiens
ggaggaggaggcggtgctggca

SEQ ID NO: 95 - DNA, 24 bp, Homo sapiens
agctcgccgctgctcctcctccag

SEQ ID NO: 96 - DNA, 22 bp, Homo sapiens
gctcgccgctgctcctcctcca

SEQ ID NO: 97 - DNA, 31 bp, Homo sapiens
cctcggagtcggaggcggtgtcagaggtggg

SEQ ID NO: 98 - DNA, 22 bp, Homo sapiens
tcggaggcggtgtcagaggtgg

SEQ ID NO: 99 - DNA, 26 bp, Homo sapiens
gcccccagaatgccccagcctagtct

SEQ ID NO: 100 - DNA, 22 bp, Homo sapiens
gcccccagaatgccccagccta

SEQ ID NO: 101 - DNA, 44 bp, Homo sapiens
gagcttttccgggtacatgtgggcctccagcgagcgcacctgct

SEQ ID NO: 102 - DNA, 22 bp, Homo sapiens
gggcctccagcgagcgcacctg

SEQ ID NO: 103 - DNA, 22 bp, Homo sapiens
tccgggtacatgtgggcctcca

SEQ ID NO: 104 - DNA, 42 bp, Homo sapiens
ttcgcccatgtctctccctgtggctgccccggctccctccag

SEQ ID NO: 105 - DNA, 22 bp, Homo sapiens
ccctgtggctgccccggctccc

SEQ ID NO: 106 - DNA, 37 bp, Homo sapiens
ccgatgctcccacagctctgcgacaccccagccccgg

SEQ ID NO: 107 - DNA, 22 bp, Homo sapiens
gctctgcgacaccccagccccg

SEQ ID NO: 108 - DNA, 34 bp, Homo sapiens
gtcttttgaccaccccccacagtccccaggaagg

SEQ ID NO: 109 - DNA, 22 bp, Homo sapiens
ccaccccccacagtccccagga

SEQ ID NO: 110 - DNA, 26 bp, Homo sapiens
ccaggcacagcagggcagagggagga

SEQ ID NO: 111 - DNA, 23 bp, Homo sapiens
ccaggcacagcagggcagaggga

SEQ ID NO: 112 - DNA, 29 bp, Homo sapiens
gctccccctgtcccgccccctcccccagg

SEQ ID NO: 113 - DNA, 21 bp, Homo sapiens
tgtcccgccccctcccccagg

SEQ ID NO: 114 - DNA, 46 bp, Homo sapiens
gaggcccctgagctcatccccgtgcccccgactgcgcttctcaccg

SEQ ID NO: 115 - DNA, 22 bp, Homo sapiens
cccccgactgcgcttctcaccg

SEQ ID NO: 116 - DNA, 22 bp, Homo sapiens
tccccgtgcccccgactgcgct

SEQ ID NO: 117 - DNA, 63 bp, Homo sapiens
tccagtcccctgctgcttgcctcacccccgctcctcctctccccaagcccgaccccgagtagc

SEQ ID NO: 118 - DNA, 22 bp, Homo sapiens
cctctccccaagcaagaccccg

SEQ ID NO: 119 - DNA, 22 bp, Homo sapiens
cccccgctcctcctctccccaa

SEQ ID NO: 120 - DNA, 23 bp, Homo sapiens
cctgctgcttgcctcacccccgc

SEQ ID NO: 121 - DNA, 34 bp, Homo sapiens
ccaccttctagcgggtcgggtcgtctctgctgcc

SEQ ID NO: 122 - DNA, 24 bp, Homo sapiens
gcgggtcgggtcgtctctgctgcc

SEQ ID NO: 123 - DNA, 37 bp, Homo sapiens
ggctagctaccgtgtcgctgcccctggctccccagtt

SEQ ID NO: 124 - DNA, 22 bp, Homo sapiens
tgtcgctgcccctggctcccca

SEQ ID NO: 125 - DNA, 39 bp, Homo sapiens
ttcaaattccatccccccaccccctccccaccgccggtt

SEQ ID NO: 126 - DNA, 22 bp, Homo sapiens
cccaccccctccccaccgccgg

SEQ ID NO: 127 - DNA, 37 bp, Homo sapiens
ttctcttatctccccatccccaggtcggcctccatag

SEQ ID NO: 128 - DNA, 22 bp, Homo sapiens
ccccatccccaggtcggcctcc

SEQ ID NO: 129 - DNA, 44 bp, Homo sapiens
atcccagcacatttaccaagccgcccccaacccattccctattt

SEQ ID NO: 130 - DNA, 22 bp, Homo sapiens
aagccgcccccaacccattccc

SEQ ID NO: 131 - DNA, 23 bp, Homo sapiens
gcacatttaccaagccgccccca

SEQ ID NO: 132 - DNA, 35 bp, Homo sapiens
ggaaccgagcaagccccgcccccatacctgccagg

SEQ ID NO: 133 - DNA, 22 bp, Homo sapiens
agccccgcccccatacctgcca

SEQ ID NO: 134 - DNA, 22 bp, Homo sapiens
aaccgagcaagccccgccccca

SEQ ID NO: 135 - DNA, 39 bp, Homo sapiens
ggtccggctgcccatctcctccatccgcgcgcgcagccg

SEQ ID NO: 136 - DNA, 22 bp, Homo sapiens
cctccatccgcgcgcgcagccg

SEQ ID NO: 137 - DNA, 23 bp, Homo sapiens
gcccatctcctccatccgcgcgc

SEQ ID NO: 138 - DNA, 22 bp, Homo sapiens
ggtccggctgcccatctcctcc

SEQ ID NO: 139 - DNA, 40 bp, Homo sapiens
accccatctccacacacaccacccccccccaaattaatcc

SEQ ID NO: 140 - DNA, 22 bp, Homo sapiens
ccacacacaccaccccccccca

SEQ ID NO: 141 - DNA, 50 bp, Homo sapiens
agtgaggactcctcccacccccagcgcccccaacccggcctcaccccagg

SEQ ID NO: 142 - DNA, 22 bp, Homo sapiens
cccccaacccggcctcacccca

SEQ ID NO: 143 - DNA, 22 bp, Homo sapiens
acccccagcgcccccaacccgg

SEQ ID NO: 144 - DNA, 39 bp, Homo sapiens
ccactcggtctgctggcgcagctcgggctccggctctgt

SEQ ID NO: 145 - DNA, 22 bp, Homo sapiens
ctggcgcagctcgggctccggc

SEQ ID NO: 146 - DNA, 31 bp, Homo sapiens
ccagcactttgggaggccgaggcgggaggat

SEQ ID NO: 147 - DNA, 22 bp, Homo sapiens
ttgggaggccgaggcgggagga

SEQ ID NO: 148 - DNA, 40 bp, Homo sapiens
gacgaagaaggagctaggaggccgggcaaggtgctcatgc

SEQ ID NO: 149 - DNA, 23 bp, Homo sapiens
ggaggccgggcaaggtgctcatg

SEQ ID NO: 150 - DNA, 46 bp, Homo sapiens
tgcgccgcctgcagctccttggacagccgtgcccgcgtctcctccg

SEQ ID NO: 151 - DNA, 22 bp, Homo sapiens
agccgtgcccgcgtctcctccg

SEQ ID NO: 152 - DNA, 22 bp, Homo sapiens
tccttggacagccgtgcccgcg

SEQ ID NO: 153 - DNA, 37 bp, Homo sapiens
tgctcagacagtgtctgcacccagcgcaggtaatccc

SEQ ID NO: 154 - DNA, 22 bp, Homo sapiens
gcaccaggcggccgcgcacgtc

SEQ ID NO: 155 - DNA, 29 bp, Homo sapiens
ccctcgcgggccccggcctggtacactgc

SEQ ID NO: 156 - DNA, 22 bp, Homo sapiens
ccctcgcgggccccggcctggt

SEQ ID NO: 157 - DNA, 25 bp, Homo sapiens
cccgcacgcgcccctgttccaccag

SEQ ID NO: 158 - DNA, 22 bp, Homo sapiens
cgcacgcggccctgttccacca

SEQ ID NO: 159 - DNA, 37 bp, Homo sapiens
acctgctccttcacctcgtccaggcggtcgcgggtcc

SEQ ID NO: 160 - DNA, 22 bp, Homo sapiens
tcgtccaggcggtcgcgggtcc

SEQ ID NO: 161 - DNA, 38 bp, Homo sapiens
ctgctgggcctgctcctccagcttggcgcgcacctccg

SEQ ID NO: 162 - DNA, 22 bp, Homo sapiens
tccagcttggcgcgcacctccg

SEQ ID NO: 163 - DNA, 50 bp, Homo sapiens
ggcagcctgcaccttctccaccagcccggcccactggcgctgcatgtctt

SEQ ID NO: 164 - DNA, 22 bp, Homo sapiens
cccggcccactggcgctgcatg

SEQ ID NO: 165 - DNA, 22 bp, Homo sapiens
ccttctccaccagcccggccca

SEQ ID NO: 166 - DNA, 23 bp, Homo sapiens
tgcgcggaggcaggaggcacggg

SEQ ID NO: 167 - DNA, 22 bp, Homo sapiens
gcgcggaggcaggaggcacggg

SEQ ID NO: 168 - DNA, 46 bp, Homo sapiens
taatctcagcactttgggaggccggcgggtggatcacttggtcagg

SEQ ID NO: 169 - DNA, 22 bp, Homo sapiens
ggccggcgggtggatcacttgg

SEQ ID NO: 170 - DNA, 23 bp, Homo sapiens
cagcactttgggaggccggcggg

SEQ ID NO: 171 - DNA, 22 bp, Homo sapiens
gggcagaggccgggcatggtgg

SEQ ID NO: 172 - DNA, 33 bp, Homo sapiens
ccagcactttgggaggccgatggcggaggatct

SEQ ID NO: 173 - DNA, 22 bp, Homo sapiens
ttgggaggccgatggcggagga

SEQ ID NO: 174 - DNA, 45 bp, Homo sapiens
gccgctcggagcccatgcctggaatcccagcactttgggaggccg

SEQ ID NO: 175 - DNA, 22 bp, Homo sapiens
gccgctcggagcccatgcctgg

SEQ ID NO: 176 - DNA, 32 bp, Homo sapiens
gggaaaacagagggttctctccgccggaattc

SEQ ID NO: 177 - DNA, 22 bp, Homo sapiens
agggttctctccgccggaattc

SEQ ID NO: 178 - DNA, 37 bp, Homo sapiens
cacctacttcccttaccccgcctccccttctcttgct

SEQ ID NO: 179 - DNA, 22 bp, Homo sapiens
accccgcctccccttctcttgc

SEQ ID NO: 180 - DNA, 35 bp, Homo sapiens
aggcctccctcgctctcccgctgctgctgccttcg

SEQ ID NO: 181 - DNA, 22 bp, Homo sapiens
tcgctctcccgctgctgctgcc

SEQ ID NO: 182 - DNA, 26 bp, Homo sapiens
gctacagcttccgcctcgccgccgcc

SEQ ID NO: 183 - DNA, 22 bp, Homo sapiens
acagcttccgcctcgccgccgc

SEQ ID NO: 184 - DNA, 41 bp, Homo sapiens
ccgccgccgccgccaccaccacccccaccaccaccacacgg

SEQ ID NO: 185 - DNA, 22 bp, Homo sapiens
gccgccgccaccaccaccccca

SEQ ID NO: 186 - DNA, 22 bp, Homo sapiens
gccaccaccacccccaccacca

SEQ ID NO: 187 - DNA, 34 bp, Homo sapiens
gccgggaggtgctgcgctcgcggcctctgggtgc

SEQ ID NO: 188 - DNA, 22 bp, Homo sapiens
gctgcgctcgcggcctctgggt

SEQ ID NO: 189 - DNA, 22 bp, Homo sapiens
ccgggaggtgctgcgctcgcgg

SEQ ID NO: 190 - DNA, 44 bp, Homo sapiens
ggaaagctcctcggtaggtcttggacggcggccgagggtagacc

SEQ ID NO: 191 - DNA, 22 bp, Homo sapiens
ggtcttggacggcggccgaggg

SEQ ID NO: 192 - DNA, 26 bp, Homo sapiens
ccatgcaggctcgccaggtccccata

SEQ ID NO: 193 - DNA, 22 bp, Homo sapiens
atgcaggctcgccaggtcccca

SEQ ID NO: 194 - DNA, 28 bp, Homo sapiens
catcattttgctccaggctccgctcggg

SEQ ID NO: 195 - DNA, 22 bp, Homo sapiens
tttgctccaggctccgctcggg

SEQ ID NO: 196 - DNA, 45 bp, Homo sapiens
attcaatgaggactccccagtcgcccccataccacgactgcttag

SEQ ID NO: 197 - DNA, 22 bp, Homo sapiens
ccccagtcgcccccataccacg

SEQ ID NO: 198 - DNA, 31 bp, Homo sapiens
tgagatactgcacgtggtgacagccccgccc

SEQ ID NO: 199 - DNA, 22 bp, Homo sapiens
gcacgtggtgacagccccgccc

SEQ ID NO: 200 - DNA, 43 bp, Homo sapiens
atgatgactgagtcagttcgggctgggccaaatttcaatgtca

SEQ ID NO: 201 - DNA, 22 bp, Homo sapiens
tgagtcagttcgggctgggcca

SEQ ID NO: 202 - DNA, 26 bp, Homo sapiens
gcccagcagcagccaccagttttttg

SEQ ID NO: 203 - DNA, 22 bp, Homo sapiens
gcccagcagcagccaccagttt

SEQ ID NO: 204 - DNA, 31 bp, Homo sapiens
ctggatcttcatctactgtgcgccgccgtcg

SEQ ID NO: 205 - DNA, 22 bp, Homo sapiens
catctactgtgcgccgccgtcg

SEQ ID NO: 206 - DNA, 33 bp, Homo sapiens
gcggtgtgccaatgccagagcccccgacttcag

SEQ ID NO: 207 - DNA, 22 bp, Homo sapiens
tgtgccaatgccagagcccccg

SEQ ID NO: 208 - DNA, 33 bp, Homo sapiens
actttgttgttagcaccaggagccgcccacagc

SEQ ID NO: 209 - DNA, 22 bp, Homo sapiens
agcaccaggagccgcccacagc

SEQ ID NO: 210 - DNA, 32 bp, Homo sapiens
cagatgatgcggtcctcctcctcggtccagca

SEQ ID NO: 211 - DNA, 22 bp, Homo sapiens
tgcggtcctcctcctcggtcca

SEQ ID NO: 212 - DNA, 34 bp, Homo sapiens
gttcagaaactgggagggcgagaagggcagggtc

SEQ ID NO: 213 - DNA, 22 bp, Homo sapiens
tgggagggcgagaagggcaggg

SEQ ID NO: 214 - DNA, 35 bp, Homo sapiens
gcatgaaaagctggtccctggtccccccgcaggcc

SEQ ID NO: 215 - DNA, 22 bp, Homo sapiens
gctggtccctggtccccccgca

SEQ ID NO: 216 - DNA, 42 bp, Homo sapiens
ggtatcgcgtccccaccgtgcagcctccccccgccttccgag

SEQ ID NO: 217 - DNA, 22 bp, Homo sapiens
gcagcctccccccgccttccga

SEQ ID NO: 218 - DNA, 37 bp, Homo sapiens
ctcaagaccaggcccccaatcaacaccagccccacgg

SEQ ID NO: 219 - DNA, 22 bp, Homo sapiens
gcccccaatcaacaccagcccc

SEQ ID NO: 220 - DNA, 52 bp, Homo sapiens
ctcttctgtgtcaaagttgttccggttgccgccacatccgccgtaaaagaat

SEQ ID NO: 221 - DNA, 22 bp, Homo sapiens
ggttgccgccacatccgccgta

SEQ ID NO: 222 - DNA, 48 bp, Homo sapiens
gagtggactgtcctcggtcggcagcagggcgggcatcaacaggctcaa

SEQ ID NO: 223 - DNA, 22 bp, Homo sapiens
ctcggtcggcagcagggcgggc

SEQ ID NO: 224 - DNA, 23 bp, Homo sapiens
cgtgctctcgcctaccgctgccg

SEQ ID NO: 225 - DNA, 24 bp, Homo sapiens
cgccgccaccgccgccgtctcccg

SEQ ID NO: 226 - DNA, 21 bp, Homo sapiens
ccgccaccgccgccgtctccg

SEQ ID NO: 227 - DNA, 42 bp, Homo sapiens
catagtctgtgtctgctccgccccaccagacatccgagtcat

SEQ ID NO: 228 - DNA, 22 bp, Homo sapiens
gctccgccccaccagacatccg

SEQ ID NO: 229 - DNA, 48 bp, Homo sapiens
gagtggtcagtcctcggtcggcagcagggcgggcatcaacaggctcaa

SEQ ID NO: 230 - DNA, 22 bp, Homo sapiens
tcggtcggcagcagggcgggca

SEQ ID NO: 231 - DNA, 48 bp, Homo sapiens
gtaattgaagaccagcagagcacccctccccacccgccccgtaaaagt

SEQ ID NO: 232 - DNA, 23 bp, Homo sapiens
gcacccctccccacccgccccgt

SEQ ID NO: 233 - DNA, 23 bp, Homo sapiens
gggcccccgcgcacgctcctccg

SEQ ID NO: 234 - DNA, 22 bp, Homo sapiens
ggcccccgcgcacgctcctccg

SEQ ID NO: 235 - DNA, 37 bp, Homo sapiens
gatccgccgcgtccttgctctgcccgcgccgccaccg

SEQ ID NO: 236 - DNA, 22 bp, Homo sapiens
tgctctgcccgcgccgccaccg

SEQ ID NO: 237 - DNA, 27 bp, Homo sapiens
ccaggcggcggcggtcattgagcatgg

SEQ ID NO: 238 - DNA, 22 bp, Homo sapiens
aggcggcggcggtcattgagca

SEQ ID NO: 239 - DNA, 29 bp, Homo sapiens
ggtgcctccccccccattcgccctgctcg

SEQ ID NO: 240 - DNA, 20 bp, Homo sapiens
ccccccattcgccctgctcg

SEQ ID NO: 241 - DNA, 22 bp, Homo sapiens
ggtgcctccccccccattcgcc

SEQ ID NO: 242 - DNA, 32 bp, Homo sapiens
gagtctgtgtccacggcggcaatcatcctctg

SEQ ID NO: 243 - DNA, 22 bp, Homo sapiens
ccacggcggcaatcatcctctg

SEQ ID NO: 244 - DNA, 33 bp, Homo sapiens
tcttcttccagatggtgagcgaggcggtgagca

SEQ ID NO: 245 - DNA, 22 bp, Homo sapiens
atggtgagcgaggcggtgagca

SEQ ID NO: 246 - DNA, 23 bp, Homo sapiens
ggctgctccccggacccgtccat

SEQ ID NO: 247 - DNA, 35 bp, Homo sapiens
cttcatgatctgctcagagctggtgggccccccgc

SEQ ID NO: 248 - DNA, 22 bp, Homo sapiens
tcagagctggtgggccccccgc

SEQ ID NO: 249 - DNA, 42 bp, Homo sapiens
ggacgcatcctgaggcaccgggtccagggccagctcgggtgc

SEQ ID NO: 250 - DNA, 22 bp, Homo sapiens
ggtccagggccagctcgggtgc

SEQ ID NO: 251 - DNA, 22 bp, Homo sapiens
caccgggtccagggccagctcg

SEQ ID NO: 252 - DNA, 29 bp, Homo sapiens
gctccatgttactgtccagttcgtccccg

SEQ ID NO: 253 - DNA, 22 bp, Homo sapiens
ccagttcgtccccgatgcgctt

SEQ ID NO: 254 - DNA, 35 bp, Homo sapiens
ggagcccagccccctctctcttgcacgccccttgg

SEQ ID NO: 255 - DNA, 22 bp, Homo sapiens
gccccctctctcttgcacgccc

SEQ ID NO: 256 - DNA, 33 bp, Homo sapiens
gccccctcgcttgcttcctcctccatcgcccgg

SEQ ID NO: 257 - DNA, 22 bp, Homo sapiens
tgcttcctcctccatcgcccgg

SEQ ID NO: 258 - DNA, 40 bp, Homo sapiens
atcttttgtatcacaggtcgggagaggaggtggctgcggg

SEQ ID NO: 259 - DNA, 22 bp, Homo sapiens
cgggagaggaggtggctgcggg

SEQ ID NO: 260 - DNA, 46 bp, Homo sapiens
gcagtcccccccgcccccactcccgctcccccgcaccacctacatt

SEQ ID NO: 261 - DNA, 22 bp, Homo sapiens
actcccgctcccccgcaccacc

SEQ ID NO: 262 - DNA, 23 bp, Homo sapiens
aaatgcgtggtttgtctgaattc

SEQ ID NO: 263 - DNA, 22 bp, Homo sapiens
cctgccacccgggagcccagcc

SEQ ID NO: 264 - DNA, 45 bp, Homo sapiens
gcccgccggtaccgcagttcaaactcgtcgcctgcctccctcagc

SEQ ID NO: 265 - DNA, 22 bp, Homo sapiens
ctcgtcgcctgcctccctcagc

SEQ ID NO: 266 - DNA, 44 bp, Homo sapiens
gtctacgctttccacgcacagtgccccgccgaaggagaaaaagg

SEQ ID NO: 267 - DNA, 22 bp, Homo sapiens
tccacgcacagtgccccgccga

SEQ ID NO: 268 - DNA, 27 bp, Homo sapiens
ccctttcggctctcggctgctgcattg

SEQ ID NO: 269 - DNA, 22 bp, Homo sapiens
tcggctctcggctgctgcattg

SEQ ID NO: 270 - DNA, 41 bp, Homo sapiens
cgactgaagagtgagcccagcagaaccacgccggccacagt

SEQ ID NO: 271 - DNA, 22 bp, Homo sapiens
ccagcagaaccacgccggccac

SEQ ID NO: 272 - DNA, 45 bp, Homo sapiens
cgggttctcctggtggcaatggcggctggacggaggatgtggtgg

SEQ ID NO: 273 - DNA, 22 bp, Homo sapiens
gcggctggacggaggatgtggt

SEQ ID NO: 274 - DNA, 22 bp, Homo sapiens
ggtggcaatggcggctggacgg

SEQ ID NO: 275 - DNA, 49 bp, Homo sapiens
ctctaggtggtcattcaggtaagtggccatccaagctgcgatccgactc

SEQ ID NO: 276 - DNA, 22 bp, Homo sapiens
ggccatccaagctgcgatccga

SEQ ID NO: 277 - DNA, 36 bp, Homo sapiens
gagctgggatgtcaggtcactgaatgcccgccggta

SEQ ID NO: 278 - DNA, 22 bp, Homo sapiens
caggtcactgaatgcccgccgg

SEQ ID NO: 279 - DNA, 25 bp, Homo sapiens
ccacggagagcggcgggcgggagcg

SEQ ID NO: 280 - DNA, 18 bp, Homo sapiens
ccacggagagcggcgggc

SEQ ID NO: 281 - DNA, 25 bp, Homo sapiens
gctggcagcggcggcggcggcagcg

SEQ ID NO: 282 - DNA, 22 bp, Homo sapiens
gctggcagcggcggcggcggca

SEQ ID NO: 283 - DNA, 44 bp, Homo sapiens
agctcgagtttttttttggcagcggcggcggcagatgaattaca

SEQ ID NO: 284 - DNA, 22 bp, Homo sapiens
tggcagcggcggcggcagatga

SEQ ID NO: 285 - DNA, 41 bp, Homo sapiens
gcgcggcgcccacatctcccgcatcccactcgtagcccctc

SEQ ID NO: 286 - DNA, 22 bp, Homo sapiens
cccgcatcccactcgtagcccc

SEQ ID NO: 287 - DNA, 22 bp, Homo sapiens
cgcccacatctcccgcatccca

SEQ ID NO: 288 - DNA, 20 bp, Homo sapiens
gcgcggcgcccacatctccc

SEQ ID NO: 289 - DNA, 25 bp, Homo sapiens
gcggtagcggcgggagaagtcgtcg

SEQ ID NO: 290 - DNA, 22 bp, Homo sapiens
gcggtagcggcgggagaagtcg

SEQ ID NO: 291 - DNA, 31 bp, Homo sapiens
ccgcggaaggagggcaggagggctctgggtg

SEQ ID NO: 292 - DNA, 22 bp, Homo sapiens
cgcggaaggagggcaggagggc

SEQ ID NO: 293 - DNA, 27 bp, Homo sapiens
cggagccccggcaccttcgctggcagc

SEQ ID NO: 294 - DNA, 22 bp, Homo sapiens
ccccggcaccttcgctggcagc

SEQ ID NO: 295 - DNA, 35 bp, Homo sapiens
accctttctcctcctcctggtcctgcgcggcggcg

SEQ ID NO: 296 - DNA, 22 bp, Homo sapiens
cctcctggtcctgcgcggcggc

SEQ ID NO: 297 - DNA, 36 bp, Homo sapiens
ctatccacgggaccgcttcacgcctccccaggagag

SEQ ID NO: 298 - DNA, 22 bp, Homo sapiens
accgcttcacgcctccccagga

SEQ ID NO: 299 - DNA, 22 bp, Homo sapiens
ccacgggaccgcttcacgcctc

SEQ ID NO: 300 - DNA, 44 bp, Homo sapiens
gcacctctcgccccagctcccaccccacggcccccagagaaaga

SEQ ID NO: 301 - DNA, 22 bp, Homo sapiens
cgccccagctcccaccccacgg

SEQ ID NO: 302 - DNA, 22 bp, Homo sapiens
cccaccccacggcccccagaga

SEQ ID NO: 303 - DNA, 45 bp, Homo sapiens
gttgtcgtaccccgttctcccagcgtgcgccatccttcccagagg

SEQ ID NO: 304 - DNA, 22 bp, Homo sapiens
cccagcgtgcgccatccttccc

SEQ ID NO: 305 - DNA, 28 bp, Homo sapiens
gggtctgcagcggcgaggtcctggcgac

SEQ ID NO: 306 - DNA, 22 bp, Homo sapiens
tgcagcggcgaggtcctggcga

SEQ ID NO: 307 - DNA, 34 bp, Homo sapiens
gtggaccacaggtggcaccgggctgagcgcaggc

SEQ ID NO: 308 - DNA, 22 bp, Homo sapiens
tggcaccgggctgagcgcaggc

SEQ ID NO: 309 - DNA, 26 bp, Homo sapiens
caccaccgtggcaaagcgtccccgcg

SEQ ID NO: 310 - DNA, 22 bp, Homo sapiens
accgtggcaaagcgtccccgcg

SEQ ID NO: 311 - DNA, 26 bp, Homo sapiens
tcattctgttccctgaggcccgccgg

SEQ ID NO: 312 - DNA, 22 bp, Homo sapiens
tctgttccctgaggcccgccgg

SEQ ID NO: 313 - DNA, 32 bp, Homo sapiens
tcccattgcccaggagcccacccgcactccaa

SEQ ID NO: 314 - DNA, 22 bp, Homo sapiens
cccacccgcactccaacccccg

SEQ ID NO: 315 - DNA, 22 bp, Homo sapiens
ttgcccaggagcccacccgcac

SEQ ID NO: 316 - DNA, 28 bp, Homo sapiens
aggtagggacacgccgggaagcaacaac

SEQ ID NO: 317 - DNA, 22 bp, Homo sapiens
gggacacgccgggaagcaacaa

SEQ ID NO: 318 - DNA, 34 bp, Homo sapiens
actggaagctgggactggttggttgggtggctgc

SEQ ID NO: 319 - DNA, 22 bp, Homo sapiens
tgggactggttggttgggtggc

SEQ ID NO: 320 - DNA, 44 bp, Homo sapiens
tgaatactctgtggtctgctcgggcttgatgggctctgtggtgg

SEQ ID NO: 321 - DNA, 22 bp, Homo sapiens
ggtctgctcgggcttgatgggc

SEQ ID NO: 322 - DNA, 34 bp, Homo sapiens
gccttcatgtcgtccagcccaccagccagcgagg

SEQ ID NO: 323 - DNA, 22 bp, Homo sapiens
cgtccagcccaccagccagcga

SEQ ID NO: 324 - DNA, 21 bp, Homo sapiens
gggcggctcctcgggcggcac

SEQ ID NO: 325 - DNA, 21 bp, Homo sapiens
gggcggctcctcgggcggcag

SEQ ID NO: 326 - DNA, 32 bp, Homo sapiens
gggtcagtgacggtcataggcagtggcggctg

SEQ ID NO: 327 - DNA, 22 bp, Homo sapiens
cggtcataggcagtggcggctg

SEQ ID NO: 328 - DNA, 23 bp, Homo sapiens
gccccagccccagcacctccatg

SEQ ID NO: 329 - DNA, 22 bp, Homo sapiens
gccccagccccagcacctccat

SEQ ID NO: 330 - DNA, 39 bp, Homo sapiens
gatcagatgatctcctgcgtcccatccagccctcacatt

SEQ ID NO: 331 - DNA, 22 bp, Homo sapiens
tgcgtcccatccagccctcaca

SEQ ID NO: 332 - DNA, 30 bp, Homo sapiens
ggtaaagagatgatggcacctggcaccccc

SEQ ID NO: 333 - DNA, 22 bp, Homo sapiens
gatgatggcacctggcaccccc

SEQ ID NO: 334 - DNA, 32 bp, Homo sapiens
gcctcaggtgcccacccccatctgcttgcttg

SEQ ID NO: 335 - DNA, 22 bp, Homo sapiens
tgcccacccccatctgcttgct

SEQ ID NO: 336 - DNA, 24 bp, Homo sapiens
gcccagccccgccgccttttctag

SEQ ID NO: 337 - DNA, 22 bp, Homo sapiens
gcccagccccgccgccttttct

SEQ ID NO: 338 - DNA, 26 bp, Homo sapiens
cgccgcccgccttgtgattgctgttg

SEQ ID NO: 339 - DNA, 22 bp, Homo sapiens
cgccgcccgccttgtgattgct

SEQ ID NO: 340 - DNA, 44 bp, Homo sapiens
acctggcgcccgggctccctaggtgctggctggctgcggtccgg

SEQ ID NO: 341 - DNA, 22 bp, Homo sapiens
aggtgctggctggctgcggtcc

SEQ ID NO: 342 - DNA, 36 bp, Homo sapiens
atccccccgccccccccacacacacacctggcgccc

SEQ ID NO: 343 - DNA, 22 bp, Homo sapiens
gccccccccacacacacacctg

SEQ ID NO: 344 - DNA, 39 bp, Homo sapiens
cgggccgtcgggtctgaggtatgggtcgttgctgagtct

SEQ ID NO: 345 - DNA, 22 bp, Homo sapiens
cgggccgtcgggtctgaggtat

SEQ ID NO: 346 - DNA, 30 bp, Homo sapiens
gctcagagcaagtcccgagcccccgagccg

SEQ ID NO: 347 - DNA, 22 bp, Homo sapiens
caagtcccgagcccccgagccg

SEQ ID NO: 348 - DNA, 39 bp, Homo sapiens
gggattgccgctttctgccacctccccgaagaagccagg

SEQ ID NO: 349 - DNA, 22 bp, Homo sapiens
ccgctttctgccacctccccga

SEQ ID NO: 350 - DNA, 36 bp, Homo sapiens
gaagcagaccttcatcccctaacctccagccctcgg

SEQ ID NO: 351 - DNA, 22 bp, Homo sapiens
tcccctaacctccagccctcgg

SEQ ID NO: 352 - DNA, 38 bp, Homo sapiens
tatcaatgaaactgccttacacacccgcccgctgcacc

SEQ ID NO: 353 - DNA, 22 bp, Homo sapiens
gccttacacacccgcccgctgc

SEQ ID NO: 354 - DNA, 47 bp, Homo sapiens
tcctcatccgttccaccttgcccctcctgccaatgctctgcgctcgg

SEQ ID NO: 355 - DNA, 22 bp, Homo sapiens
cccctcctgccaatgctctgcg

SEQ ID NO: 356 - DNA, 30 bp, Homo sapiens
gcttcccacccagcccccacattcccagga

SEQ ID NO: 357 - DNA, 22 bp, Homo sapiens
cccacccagcccccacattccc

SEQ ID NO: 358 - DNA, 30 bp, Homo sapiens
ggctcattgctgctgctgcccttgcggtgg

SEQ ID NO: 359 - DNA, 22 bp, Homo sapiens
gctgctgctgcccttgcggtgg

SEQ ID NO: 360 - DNA, 34 bp, Homo sapiens
gagcaactttttctcccccacttccgcccactat

SEQ ID NO: 361 - DNA, 22 bp, Homo sapiens
ttttctcccccacttccgccca

SEQ ID NO: 362 - DNA, 25 bp, Homo sapiens
cgcgagcagaggcagaagggcggtc

SEQ ID NO: 363 - DNA, 21 bp, Homo sapiens
gcgagcagaggcagaagggcg

SEQ ID NO: 364 - DNA, 32 bp, Homo sapiens
cgcacgcacccgctggctgtcgtccccgctgc

SEQ ID NO: 365 - DNA, 22 bp, Homo sapiens
cgcacgcacccgctggctgtcg

SEQ ID NO: 366 - DNA, 22 bp, Homo sapiens
cgctggctgtcgtccccgctgc

SEQ ID NO: 367 - DNA, 31 bp, Homo sapiens
gccgccgctgccgctgccccctgccaccgag

SEQ ID NO: 368 - DNA, 22 bp, Homo sapiens
tgccgctgccccctgccaccga

SEQ ID NO: 369 - DNA, 32 bp, Homo sapiens
caggtggtgcggcggctgctgctgctgctggg

SEQ ID NO: 370 - DNA, 22 bp, Homo sapiens
tggtgcggcggctgctgctgct

SEQ ID NO: 371 - DNA, 32 bp, Homo sapiens
ttttttcttcgttgcccctcagcccccgacgg

SEQ ID NO: 372 - DNA, 22 bp, Homo sapiens
cttcgttgcccctcagcccccg

SEQ ID NO: 373 - DNA, 57 bp, Homo sapiens
gctctcacaaacctccctcctgccgcccctccccaaccctccccccgctttgtgttc

SEQ ID NO: 374 - DNA, 22 bp, Homo sapiens
ccccaaccctccccccgctttg

SEQ ID NO: 375 - DNA, 22 bp, Homo sapiens
caaacctccctcctgccgcccc

SEQ ID NO: 376 - DNA, 27 bp, Homo sapiens
cgcacctccactcccgcctcgctgctt

SEQ ID NO: 377 - DNA, 22 bp, Homo sapiens
cgcacctccactcccgcctcgc

SEQ ID NO: 378 - DNA, 33 bp, Homo sapiens
gcgtggggtaccgctgctttccgccgctgtcaa

SEQ ID NO: 379 - DNA, 22 bp, Homo sapiens
ccgctgctttccgccgctgtca

SEQ ID NO: 380 - DNA, 28 bp, Homo sapiens
gcggaggtgcggcttcaggctccccact

SEQ ID NO: 381 - DNA, 22 bp, Homo sapiens
aggtgcggcttcaggctcccca

SEQ ID NO: 382 - DNA, 26 bp, Homo sapiens
ggtgccgcctcccgctgcccgccgcc

SEQ ID NO: 383 - DNA, 22 bp, Homo sapiens
ggtgccgcctcccgctgcccgc

SEQ ID NO: 384 - DNA, 26 bp, Homo sapiens
cactgctggctggctggcttttgaag

SEQ ID NO: 385 - DNA, 22 bp, Homo sapiens
tgctggctggctggcttttgaa

SEQ ID NO: 386 - DNA, 24 bp, Homo sapiens
ggcggagcctgagcaaaacccatc

SEQ ID NO: 387 - DNA, 22 bp, Homo sapiens
gcggagcctgagcaaaacccat

SEQ ID NO: 388 - DNA, 33 bp, Homo sapiens
ggccgcccgctcgctccctctgcctctcgctgg

SEQ ID NO: 389 - DNA, 22 bp, Homo sapiens
cgcccgctcgctccctctgcct

SEQ ID NO: 390 - DNA, 36 bp, Homo sapiens
taagttccagtgcaaagtgcccgcccgctgctatgg

SEQ ID NO: 391 - DNA, 22 bp, Homo sapiens
aagtgcccgcccgctgctatgg

SEQ ID NO: 392 - DNA, 46 bp, Homo sapiens
gcccaccgcaaagcaacccccagccccccaaaacccagagagcaat

SEQ ID NO: 393 - DNA, 22 bp, Homo sapiens
gcccaccgcaaagcaaccccca

SEQ ID NO: 394 - DNA, 37 bp, Homo sapiens
ggacacatcctcgcctcccttttcccctgcctgcgcc

SEQ ID NO: 395 - DNA, 22 bp, Homo sapiens
tcccttttcccctgcctgcgcc

SEQ ID NO: 396 - DNA, 44 bp, Homo sapiens
ggaaccgcccagagccccgctcctcgcagttcctccgcatctcg

SEQ ID NO: 397 - DNA, 22 bp, Homo sapiens
ggaaccgcccagagccccgctc

SEQ ID NO: 398 - DNA, 32 bp, Homo sapiens
caccgcagcccctcccaaccttccctctccac

SEQ ID NO: 399 - DNA, 22 bp, Homo sapiens
gcaccgcagcccctcccaacct

SEQ ID NO: 400 - DNA, 36 bp, Homo sapiens
ggagaagctcccgccaccgccgtcgttgtctccccg

SEQ ID NO: 401 - DNA, 22 bp, Homo sapiens
caccgccgtcgttgtctccccg

SEQ ID NO: 402 - DNA, 42 bp, Homo sapiens
ccactcttgaggcagttcactggctcccgcactcaggcaggc

SEQ ID NO: 403 - DNA, 22 bp, Homo sapiens
tggctcccgcactcaggcaggc

SEQ ID NO: 404 - DNA, 31 bp, Homo sapiens
ttttttcttttcccccacgccctctgctttg

SEQ ID NO: 405 - DNA, 22 bp, Homo sapiens
ttcccccacgccctctgctttg

SEQ ID NO: 406 - DNA, 31 bp, Homo sapiens
gaaaggtatccagccgcccacttttgacagg

SEQ ID NO: 407 - DNA, 22 bp, Homo sapiens
ccagccgcccacttttgacagg

SEQ ID NO: 408 - DNA, 32 bp, Homo sapiens
gcgccgtaaagcccgactccagccgaaaaggg

SEQ ID NO: 409 - DNA, 22 bp, Homo sapiens
gcccgactccagccgaaaaggg

SEQ ID NO: 410 - DNA, 22 bp, Homo sapiens
cgccgtaaagcccgactccagc

SEQ ID NO: 411 - DNA, 50 bp, Homo sapiens
tattcttatctctggccttgtaaacggtggcaaactgtccctccccaagg

SEQ ID NO: 412 - DNA, 22 bp, Homo sapiens
cggtggcaaactgtccctcccc

SEQ ID NO: 413 - DNA, 33 bp, Homo sapiens
tttaaagctaccttaaagcctccaaccccgccc

SEQ ID NO: 414 - DNA, 22 bp, Homo sapiens
cttaaagcctccaaccccgccc

SEQ ID NO: 415 - DNA, 29 bp, Homo sapiens
ggaacagggcccggcgagtcaccatctca

SEQ ID NO: 416 - DNA, 23 bp, Homo sapiens
ggaacagggcccggcgagtcacc

SEQ ID NO: 417 - DNA, 34 bp, Homo sapiens
caactttactaaaatcttgccgggcccacttggg

SEQ ID NO: 418 - DNA, 22 bp, Homo sapiens
aaatcttgccgggcccacttgg

SEQ ID NO: 419 - DNA, 35 bp, Homo sapiens
attctcaaaagcaccaacttagcccccgctatcat

SEQ ID NO: 420 - DNA, 22 bp, Homo sapiens
aaagcaccaacttagcccccgc

SEQ ID NO: 421 - DNA, 53 bp, Homo sapiens
gcaatttgcaccccagcccagcgctcccggttgctcctccagcttccatgtgg

SEQ ID NO: 422 - DNA, 22 bp, Homo sapiens
tgctcctccagcttccatgtgg

SEQ ID NO: 423 - DNA, 22 bp, Homo sapiens
cccagcccagcgctcccggttg

SEQ ID NO: 424 - DNA, 22 bp, Homo sapiens
aatttgcaccccagcccagcgc

SEQ ID NO: 425 - DNA, 36 bp, Homo sapiens
gggcaccccgaaggcgcgagccaggccgaagtcagc

SEQ ID NO: 426 - DNA, 23 bp, Homo sapiens
gcgcgagccaggccgaagtcagc

SEQ ID NO: 427 - DNA, 22 bp, Homo sapiens
gggcaccccgaaggcgcgagcc

SEQ ID NO: 428 - DNA, 36 bp, Homo sapiens
ttatagtcaggcagctgggtgaccccgggccatgtg

SEQ ID NO: 429 - DNA, 22 bp, Homo sapiens
ggcagctgggtgaccccgggcc

SEQ ID NO: 430 - DNA, 34 bp, Homo sapiens
ccagggcagtcttggctgtgatccgctggctggg

SEQ ID NO: 431 - DNA, 22 bp, Homo sapiens
tggctgtgatccgctggctggg

SEQ ID NO: 432 - DNA, 36 bp, Homo sapiens
gggatgagaagtacgggtgggccagggcagtcttgg

SEQ ID NO: 433 - DNA, 22 bp, Homo sapiens
cgggtgggccagggcagtcttg

SEQ ID NO: 434 - DNA, 43 bp, Homo sapiens
gtcccaatccacctctcaatgcctaccaaccgccactcacctt

SEQ ID NO: 435 - DNA, 25 bp, Homo sapiens
caatgcctaccaaccgccactcacc

SEQ ID NO: 436 - DNA, 33 bp, Homo sapiens
tgcgtacgggcaatcactctcctatccaaccag

SEQ ID NO: 437 - DNA, 25 bp, Homo sapiens
cgggcaatcactctcctatccaacc

SEQ ID NO: 438 - DNA, 44 bp, Homo sapiens
ccctcccgggcagcgtcgtgcacgggtcgggtgagagtggcggg

SEQ ID NO: 439 - DNA, 22 bp, Homo sapiens
cgggtcgggtgagagtggcggg

SEQ ID NO: 440 - DNA, 22 bp, Homo sapiens
ccctcccgggcagcgtcgtgca

SEQ ID NO: 441 - DNA, 22 bp, Homo sapiens
gggcagcgtcgtgcacgggtcg

SEQ ID NO: 442 - DNA, 73 bp, Homo sapiens
agccgaaggctccatgctgctccccgccgccggatccatgctgctccccgccgcccgttgtctgttctccccc

SEQ ID NO: 443 - DNA, 22 bp, Homo sapiens
ccatgctgctccccgccgcccg

SEQ ID NO: 444 - DNA, 22 bp, Homo sapiens
ccccgccgcccgttgtctgttc

SEQ ID NO: 445 - DNA, 22 bp, Homo sapiens
tccatgctgctccccgccgccg

SEQ ID NO: 446 - DNA, 39 bp, Homo sapiens
gcctccagcagcgcccgcacctcctctacccgaccccgg

SEQ ID NO: 447 - DNA, 22 bp, Homo sapiens
gcgcccgcacctcctctacccg

SEQ ID NO: 448 - DNA, 22 bp, Homo sapiens
gcctccagcagcgcccgcacct

SEQ ID NO: 449 - DNA, 32 bp, Homo sapiens
gttactgcctctggtgccccccgcagccgcgc

SEQ ID NO: 450 - DNA, 22 bp, Homo sapiens
ctggtgccccccgcagccgcgc

SEQ ID NO: 451 - DNA, 22 bp, Homo sapiens
tactgcctctggtgccccccgc

SEQ ID NO: 452 - DNA, 25 bp, Homo sapiens
tccgcgccgtggagcagcagcagct

SEQ ID NO: 453 - DNA, 22 bp, Homo sapiens
ccgcgccgtggagcagcagcag

SEQ ID NO: 454 - DNA, 26 bp, Homo sapiens
cgcgccccggcccggtgcagcaccac

SEQ ID NO: 455 - DNA, 22 bp, Homo sapiens
cgcgccccggcccggtgcagca

SEQ ID NO: 456 - DNA, 34 bp, Homo sapiens
gcagacggccccaggcatcgcgcacgtccagccg

SEQ ID NO: 457 - DNA, 22 bp, Homo sapiens
aggcatcgcgcacgtccagccg

SEQ ID NO: 458 - DNA, 22 bp, Homo sapiens
acggccccaggcatcgcgcacg

SEQ ID NO: 459 - DNA, 23 bp, Homo sapiens
gcagccgcgcgcaggtaccgtgc

SEQ ID NO: 460 - DNA, 22 bp, Homo sapiens
gcagccgcgcgcaggtaccgtg

SEQ ID NO: 461 - DNA, 25 bp, Homo sapiens
gctggatgcctgacctgggaagttt

SEQ ID NO: 462 - DNA, 23 bp, Homo sapiens
gctggatgcctgacctgggaagt

SEQ ID NO: 463 - DNA, 22 bp, Homo sapiens
agcaggaggctggcccgaattc

SEQ ID NO: 464 - DNA, 66 bp, Homo sapiens
tgagtactgcctatgtgcgcagctgagaagcccgacctgagttcactggctctgcagcaggaggct

SEQ ID NO: 465 - DNA, 24 bp, Homo sapiens
ttcactggctctgcagcaggaggc

SEQ ID NO: 466 - DNA, 24 bp, Homo sapiens
gaagcccgacctgagttcactggc

SEQ ID NO: 467 - DNA, 24 bp, Homo sapiens
tgtgcgcagctgagaagcccgacc

SEQ ID NO: 468 - DNA, 33 bp, Homo sapiens
tgcgctgccctgcagaggtcaaaccccatccaa

SEQ ID NO: 469 - DNA, 22 bp, Homo sapiens
tgcgctgccctgcagaggtcaa

SEQ ID NO: 470 - DNA, 27 bp, Homo sapiens
tttttcaccttcactgggccccatggg

SEQ ID NO: 471 - DNA, 22 bp, Homo sapiens
tcaccttcactgggccccatgg

SEQ ID NO: 472 - DNA, 45 bp, Homo sapiens
cctggtaatgagtagctgccaagggttgaagcagcaggtgcctcc

SEQ ID NO: 473 - DNA, 22 bp, Homo sapiens
tgccaagggttgaagcagcagg

SEQ ID NO: 474 - DNA, 25 bp, Homo sapiens
tgagtagctgccaagggttgaagca

SEQ ID NO: 475 - DNA, 46 bp, Homo sapiens
tttccgtaatgtggactttctggtgccgagcaagttgtgagctgta

SEQ ID NO: 476 - DNA, 24 bp, Homo sapiens
tggtgccgagcaagttgtgagctc

SEQ ID NO: 477 - DNA, 37 bp, Homo sapiens
cagtgtgggttctctggtgcacggtgaggctcgacct

SEQ ID NO: 478 - DNA, 24 bp, Homo sapiens
tctggtgcacggtgaggctcgacc

SEQ ID NO: 479 - DNA, 39 bp, Homo sapiens
gggctgggtgtcagaggtgagagggcagggcaagcaggc

SEQ ID NO: 480 - DNA, 23 bp, Homo sapiens
gtgagagggcagggcaagcaggc

SEQ ID NO: 481 - DNA, 23 bp, Homo sapiens
tgggtgtcagaggtgagagggca

SEQ ID NO: 482 - DNA, 33 bp, Homo sapiens
cacaatcactacattcacccgaatcccgaattc

SEQ ID NO: 483 - DNA, 22 bp, Homo sapiens
cattcacccgaatcccgaattc

SEQ ID NO: 484 - DNA, 34 bp, Homo sapiens
ggtttctcccccgtgtggatcctccgatgcagaa

SEQ ID NO: 485 - DNA, 22 bp, Homo sapiens
ccccgtgtggatcctccgatgc

SEQ ID NO: 486 - DNA, 43 bp, Homo sapiens
cggtcgtaactctgagggagcttttgctcatgccgatcccatt

SEQ ID NO: 487 - DNA, 22 bp, Homo sapiens
gcttttgctcatgccgatccca

SEQ ID NO: 488 - DNA, 39 bp, Homo sapiens
atcgaattctgtcccgactgtgcttccatccccaccttg

SEQ ID NO: 489 - DNA, 22 bp, Homo sapiens
cccgactgtgcttccatcccca

SEQ ID NO: 490 - DNA, 38 bp, Homo sapiens
tgtttggacagatttgcccattagccccaggacaactg

SEQ ID NO: 491 - DNA, 24 bp, Homo sapiens
tgcccattagccccaggacaactg

SEQ ID NO: 492 - DNA, 35 bp, Homo sapiens
aagtgcttctgaccctctccctcacagccggttac

SEQ ID NO: 493 - DNA, 22 bp, Homo sapiens
tgaccctctccctcacagccgg

SEQ ID NO: 494 - DNA, 33 bp, Homo sapiens
ggaaggtcatcccgtcggttgggaaaactcggg

SEQ ID NO: 495 - DNA, 22 bp, Homo sapiens
ccgtcggttgggaaaactcggg

SEQ ID NO: 496 - DNA, 41 bp, Homo sapiens
gaatcccctctcccgccgccgccgccgtgtctggtctgtac

SEQ ID NO: 497 - DNA, 22 bp, Homo sapiens
cgccgccgccgtgtctggtctg

SEQ ID NO: 498 - DNA, 22 bp, Homo sapiens
gaatcccctctcccgccgccgc

SEQ ID NO: 499 - DNA, 61 bp, Homo sapiens
ggtagtccccactctcctgtctgatccctccctctcctccccgagttccaccgccccaggc

SEQ ID NO: 500 - DNA, 22 bp, Homo sapiens
ccccgagttccaccgccccagg

SEQ ID NO: 501 - DNA, 22 bp, Homo sapiens
tgatccctccctctcctccccg

SEQ ID NO: 502 - DNA, 25 bp, Homo sapiens
ccccactctcctgtctgatccctcc

SEQ ID NO: 503 - DNA, 33 bp, Homo sapiens
caggagaattgcttgaacccaggaggcggaggt

SEQ ID NO: 504 - DNA, 22 bp, Homo sapiens
gcttgaacccaggaggcggagg

SEQ ID NO: 505 - DNA, 42 bp, Homo sapiens
ctggtcctaagcagttaccctgtaaatagttaatgtgagctc

SEQ ID NO: 506 - DNA, 27 bp, Homo sapiens
taccctgtaaatagttaatgtgagctc

SEQ ID NO: 507 - DNA, 27 bp, Homo sapiens
cagtctttgcccgagcgcttccgagag

SEQ ID NO: 508 - DNA, 22 bp, Homo sapiens
tctttgcccgagcgcttccgag

SEQ ID NO: 509 - DNA, 22 bp, Homo sapiens
gccccaggcgcacaggtttccg

SEQ ID NO: 510 - DNA, 40 bp, Homo sapiens
gccaggaccgcgcacagcagcagggcgcgggcgagcatcc

SEQ ID NO: 511 - DNA, 22 bp, Homo sapiens
agcagggcgcgggcgagcatcc

SEQ ID NO: 512 - DNA, 22 bp, Homo sapiens
ggaccgcgcacagcagcagggc

SEQ ID NO: 513 - DNA, 32 bp, Homo sapiens
acctctatcttaccccatggcccagcccgttg

SEQ ID NO: 514 - DNA, 22 bp, Homo sapiens
taccccatggcccagcccgttg

SEQ ID NO: 515 - DNA, 26 bp, Homo sapiens
cgatgtggcggttggtggaaggtgcc

SEQ ID NO: 516 - DNA, 22 bp, Homo sapiens
tctggcggttggtggaaggtgc

SEQ ID NO: 517 - DNA, 27 bp, Homo sapiens
ctggcattgtagggttgggcagggtcc

SEQ ID NO: 518 - DNA, 22 bp, Homo sapiens
ggcattgtagggttgggcaggg

SEQ ID NO: 519 - DNA, 31 bp, Homo sapiens
cagtgtctggtgctgatgcgggtgcgagtgc

SEQ ID NO: 520 - DNA, 22 bp, Homo sapiens
tctggtgctgatgcgggtgcga

SEQ ID NO: 521 - DNA, 36 bp, Homo sapiens
tgaggatggtgtgctgggtgctggtgctggtgtggg

SEQ ID NO: 522 - DNA, 22 bp, Homo sapiens
tgggtgctggtgctggtgtggg

SEQ ID NO: 523 - DNA, 32 bp, Homo sapiens
gggcggatgtggcgaggtctggtgatgtgctg

SEQ ID NO: 524 - DNA, 22 bp, Homo sapiens
gggcggatgtggcgaggtctgg

SEQ ID NO: 525 - DNA, 36 bp, Homo sapiens
tccggatcctcgtctaccacccttcgccggcgcccc

SEQ ID NO: 526 - DNA, 22 bp, Homo sapiens
taccacccttcgccggcgcccc

SEQ ID NO: 527 - DNA, 22 bp, Homo sapiens
cctcgtctaccacccttcgccg

SEQ ID NO: 528 - DNA, 23 bp, Homo sapiens
cgtcaaactacacctccgccgcg

SEQ ID NO: 529 - DNA, 39 bp, Homo sapiens
tgggctaatgtggcaatctgtggctgggcttgaacttgc

SEQ ID NO: 530 - DNA, 22 bp, Homo sapiens
tgtggcaatctgtggctgggct

SEQ ID NO: 531 - DNA, 51 bp, Homo sapiens
agctcctccgtcactgctttcgttcacggcccggatctcgctggagtttta

SEQ ID NO: 532 - DNA, 22 bp, Homo sapiens
tcacggcccggatctcgctgga

SEQ ID NO: 533 - DNA, 22 bp, Homo sapiens
cactgctttcgttcacggcccg

SEQ ID NO: 534 - DNA, 25 bp, Homo sapiens
gctgggccgcctgaatgactccatg

SEQ ID NO: 535 - DNA, 22 bp, Homo sapiens
gctgggccgcctgaatgactcc

SEQ ID NO: 536 - DNA, 34 bp, Homo sapiens
tggttaatgtttgcaggccctgtaccccatcggt

SEQ ID NO: 537 - DNA, 24 bp, Homo sapiens
tttgcaggccctgtaccccatcgg

SEQ ID NO: 538 - DNA, 25 bp, Homo sapiens
cgatctggcggttggtggaaggtgc

SEQ ID NO: 539 - DNA, 22 bp, Homo sapiens
tctggcggttggtggaaggtgc

SEQ ID NO: 540 - DNA, 27 bp, Homo sapiens
ctggcattgtagggttgggcagggtcc

SEQ ID NO: 541 - DNA, 22 bp, Homo sapiens
ggcattgtagggttgggcaggg

SEQ ID NO: 542 - DNA, 31 bp, Homo sapiens; identical to SEQ ID NO: 519

SEQ ID NO: 543 - DNA, 22 bp, Homo sapiens
tctggtgctgatgcgggtgcga

SEQ ID NO: 544 - DNA, 37 bp, Homo sapiens
tgaggatggtgtgctgggtgctggtgctggtgtgggt

SEQ ID NO: 545 - DNA, 22 bp, Homo sapiens
tgggtgctggtgctggtgtggg

SEQ ID NO: 546 - DNA, 24 bp, Homo sapiens
gggcggatgtggcgaggtctggtg

SEQ ID NO: 547 - DNA, 22 bp, Homo sapiens
gggcggatgtggcgaggtctgg

SEQ ID NO: 548 - DNA, 32 bp, Homo sapiens
gtccggatcctcgtctaccacccttcgccggc

SEQ ID NO: 549 - DNA, 23 bp, Homo sapiens
tcctcgtctaccacccttcgccg

SEQ ID NO: 550 - DNA, 23 bp, Homo sapiens
aggtccttgtattgcctggcaga

SEQ ID NO: 551 - DNA, 18 bp, Homo sapiens
gtccttgtattgcctggc

SEQ ID NO: 552 - DNA, 40 bp, Homo sapiens
agatttcttctgcatggcggttacagggcaatctttatga

SEQ ID NO: 553 - DNA, 22 bp, Homo sapiens
tctgcatggcggttacagggca

SEQ ID NO: 554 - DNA, 44 bp, Homo sapiens
caacttcctgagggctgtgactgggaggaaggagccataacgat

SEQ ID NO: 555 - DNA, 22 bp, Homo sapiens
cctgagggctgtgactgggagg

SEQ ID NO: 556 - DNA, 33 bp, Homo sapiens
tcgttagctgctcttctccgacgaccacttgta

SEQ ID NO: 557 - DNA, 22 bp, Homo sapiens
agctgctcttctccgacgacca

SEQ ID NO: 558 - DNA, 47 bp, Homo sapiens
gtttctgtagtggatgtggctggctgttgtaatgactgcggtcgaga

SEQ ID NO: 559 - DNA, 22 bp, Homo sapiens
agtggatgtggctggctgttgt

SEQ ID NO: 560 - DNA, 36 bp, Homo sapiens
cattgggaacctgtaatgatgctggacgaacaatag

SEQ ID NO: 561 - DNA, 22 bp, Homo sapiens
tgggaacctgtaatgatgctgg

SEQ ID NO: 562 - DNA, 37 bp, Homo sapiens
agtcagaacttgtaagcagcacattgggaacctgtaa

SEQ ID NO: 563 - DNA, 22 bp, Homo sapiens
gtaagcagcacattgggaacct

SEQ ID NO: 564 - DNA, 23 bp, Homo sapiens
aggatggtgcctgggtgattaca

SEQ ID NO: 565 - DNA, 22 bp, Homo sapiens
ggatggtgcctgggtgattaca

SEQ ID NO: 566 - DNA, 34 bp, Homo sapiens
ccattggtaactggaggatgttgctgggtcaaag

SEQ ID NO: 567 - DNA, 22 bp, Homo sapiens
actggaggatgttgctgggtca

SEQ ID NO: 568 - DNA, 39 bp, Homo sapiens
ccacttgtactttgggtctgtggagttgtgtgagctgga

SEQ ID NO: 569 - DNA, 22 bp, Homo sapiens
gggtctgtggagttgtgtgagc

SEQ ID NO: 570 - DNA, 40 bp, Homo sapiens
agactgaacccagactttccttttttgtcggcatcttgaa

SEQ ID NO: 571 - DNA, 22 bp, Homo sapiens
tccttttttgtcggcatcttga

SEQ ID NO: 572 - DNA, 30 bp, Homo sapiens
gctgtgccacttcatttctcagcagggtga

SEQ ID NO: 573 - DNA, 22 bp, Homo sapiens
gccacttcatttctcagcaggg

SEQ ID NO: 574 - DNA, 41 bp, Homo sapiens
gaactgactccattggatgtgctgaccgaactatgctgtat

SEQ ID NO: 575 - DNA, 22 bp, Homo sapiens
ggatgtgctgaccgaactatgc

SEQ ID NO: 576 - DNA, 30 bp, Homo sapiens
gaaactggtctttccttgatttccctttga

SEQ ID NO: 577 - DNA, 22 bp, Homo sapiens
tggtctttccttgatttccctt

SEQ ID NO: 578 - DNA, 23 bp, Homo sapiens
gggaacaccaggcacatcagagg

SEQ ID NO: 579 - DNA, 30 bp, Homo sapiens
cactccctgtggcaaagcagcagtaggagc

SEQ ID NO: 580 - DNA, 22 bp, Homo sapiens
cactccctgtggcaaagcagca

SEQ ID NO: 581 - DNA, 36 bp, Homo sapiens
cctcagctctcgtttgcgtgttgcttcttctgccag

SEQ ID NO: 582 - DNA, 22 bp, Homo sapiens
ttgcgtgttgcttcttctgcca

SEQ ID NO: 583 - DNA, 35 bp, Homo sapiens
ctgacgtaaagcagggattgaattttggccagtct

SEQ ID NO: 584 - DNA, 22 bp, Homo sapiens
aagcagggattgaattttggcc

SEQ ID NO: 585 - DNA, 32 bp, Homo sapiens
tcatgctgtgattcaactgtttccatggtcat

SEQ ID NO: 586 - DNA, 22 bp, Homo sapiens
attcaactgtttccatggtcat

SEQ ID NO: 587 - DNA, 28 bp, Homo sapiens
gactgtgcaaacttccgggcgatgcagc

SEQ ID NO: 588 - DNA, 22 bp, Homo sapiens
gcaaacttccgggcgatgcagc

SEQ ID NO: 589 - DNA, 45 bp, Homo sapiens
tcttcctccatcgagcccgatttgtgccgcttgctcccactggag

SEQ ID NO: 590 - DNA, 22 bp, Homo sapiens
cgagcccgatttgtgccgcttg

SEQ ID NO: 591 - DNA, 33 bp, Homo sapiens
cgtccagttgcggctgctactcgtgggcgagct

SEQ ID NO: 592 - DNA, 22 bp, Homo sapiens
tgcggctgctactcgtgggcga

SEQ ID NO: 593 - DNA, 38 bp, Homo sapiens
tcgtagggaaatgcagagcggaggacgggtgtgggctc

SEQ ID NO: 594 - DNA, 22 bp, Homo sapiens
gcagagcggaggacgggtgtgg

SEQ ID NO: 595 - DNA, 28 bp, Homo sapiens
caggttgctggctggctgggtcgcaggc

SEQ ID NO: 596 - DNA, 22 bp, Homo sapiens
ggttgctggctggctgggtcgc

SEQ ID NO: 597 - DNA, 32 bp, Homo sapiens
gggacgtgtcgggcggagagtaggaaggcgag

SEQ ID NO: 598 - DNA, 22 bp, Homo sapiens
cgggcggagagtaggaaggcga

SEQ ID NO: 599 - DNA, 26 bp, Homo sapiens
gctgctgcgaggaggcgaggccggcg

SEQ ID NO: 600 - DNA, 22 bp, Homo sapiens
ctgcgaggaggcgaggccggcg

SEQ ID NO: 601 - DNA, 45 bp, Homo sapiens
gttgaaccaggtgtaggcgaaggcgcggacgtgaggcagcagggc

SEQ ID NO: 602 - DNA, 22 bp, Homo sapiens
ggcgcggacgtgaggcagcagg

SEQ ID NO: 603 - DNA, 22 bp, Homo sapiens
ggcgaaggcgcggacgtgaggc

SEQ ID NO: 604 - DNA, 22 bp, Homo sapiens
ccaggtgtaggcgaaggcgcgg

SEQ ID NO: 605 - DNA, 27 bp, Homo sapiens
cgcttccgcgcctgcaggttgaaccag

SEQ ID NO: 606 - DNA, 22 bp, Homo sapiens
cgcttccgcgcctgcaggttga

SEQ ID NO: 607 - DNA, 29 bp, Homo sapiens
gccagcagccgcgacgcccacttctgctt

SEQ ID NO: 608 - DNA, 22 bp, Homo sapiens
gccagcagccgcgacgcccact

SEQ ID NO: 609 - DNA, 35 bp, Homo sapiens
gcactcgggccggatgtccttgcgcagcttggcca

SEQ ID NO: 610 - DNA, 22 bp, Homo sapiens
cgggccggatgtccttgcgcag

SEQ ID NO: 611 - DNA, 24 bp, Homo sapiens
gggttggagagcacgcagcccggc

SEQ ID NO: 612 - DNA, 22 bp, Homo sapiens
gttggagagcacgcagcccggc

SEQ ID NO: 613 - DNA, 36 bp, Homo sapiens
ccttgaccaggcgctcgccgtcggtgctctccagcg

SEQ ID NO: 614 - DNA, 22 bp, Homo sapiens
accaggcgctcgccgtcggtgc

SEQ ID NO: 615 - DNA, 42 bp, Homo sapiens
ggctgcacgcacaggaccgggtgaccgcactgcgcagccttg

SEQ ID NO: 616 - DNA, 23 bp, Homo sapiens
ccgggtgaccgcactgcgcagcc

SEQ ID NO: 617 - DNA, 22 bp, Homo sapiens
cgcacaggaccgggtgaccgca

SEQ ID NO: 618 - DNA, 32 bp, Homo sapiens
gcgatgacgggccggtggtgctgggtgaagct

SEQ ID NO: 619 - DNA, 22 bp, Homo sapiens
cgggccggtggtgctgggtgaa

SEQ ID NO: 620 - DNA, 28 bp, Homo sapiens
caggttgctggctggctgggtcgcaggc

SEQ ID NO: 621 - DNA, 22 bp, Homo sapiens
gctggctggctgggtcgcaggc

SEQ ID NO: 622 - DNA, 44 bp, Homo sapiens
caccctcctgcagatatcccgcatccctttacccgtctcgtctt

SEQ ID NO: 623 - DNA, 23 bp, Homo sapiens
cccgcatccctttacccgtctcg

SEQ ID NO: 624 - DNA, 68 bp, Homo sapiens
aatagtcgtagccgccggtcgcagcccaggccagcctaccagcccgcccgctcgctcacccagctcga

SEQ ID NO: 625 - DNA, 22 bp, Homo sapiens
gccagcctaccagcccgcccgc

SEQ ID NO: 626 - DNA, 22 bp, Homo sapiens
gcccgcccgctcgctcacccag

SEQ ID NO: 627 - DNA, 22 bp, Homo sapiens
ccggtcgcagcccaggccagcc

SEQ ID NO: 628 - DNA, 22 bp, Homo sapiens
cgtagccgccggtcgcagccca

SEQ ID NO: 629 - DNA, 23 bp, Homo sapiens
cgagccaccgcacccagccttta

SEQ ID NO: 630 - DNA, 22 bp, Homo sapiens
cgagccaccgcacccagccttt

SEQ ID NO: 631 - DNA, 22 bp, Homo sapiens
cgggagaaaacgcctgcgcggg

SEQ ID NO: 632 - DNA, 43 bp, Homo sapiens
ttgaaatggaccaatgaaagcgctcgcggccttgacgtcattc

SEQ ID NO: 633 - DNA, 22 bp, Homo sapiens
gaaagcgctcgcggccttgacg

SEQ ID NO: 634 - DNA, 23 bp, Homo sapiens
gaccaatgaaagcgctcgcggcc

SEQ ID NO: 635 - DNA, 46 bp, Homo sapiens
gtgcactctgcccagccgaccactcgcaccgacccggccaaagaat

SEQ ID NO: 636 - DNA, 22 bp, Homo sapiens
ccactcgcaccgacccggccaa

SEQ ID NO: 637 - DNA, 22 bp, Homo sapiens
gcccagccgaccactcgcaccg

SEQ ID NO: 638 - DNA, 25 bp, Homo sapiens
cgggatcagcctgcggcgccaagca

SEQ ID NO: 639 - DNA, 22 bp, Homo sapiens
cgggatcagcctgcggcgccaa

SEQ ID NO: 640 - DNA, 22 bp, Homo sapiens
gcaggccccggcgcagagttgc

SEQ ID NO: 641 - DNA, 33 bp, Homo sapiens
cgggtccgcggttgttggacgggcgctgccttt

SEQ ID NO: 642 - DNA, 22 bp, Homo sapiens
cggttgttggacgggcgctgcc

SEQ ID NO: 643 - DNA, 19 bp, Homo sapiens
cgggtccgcggttgttgga

SEQ ID NO: 644 - DNA, 58 bp, Homo sapiens
gggagaagcagaacaccggagcccgaccagccaaggacctacacccagcagaaaccaa

SEQ ID NO: 645 - DNA, 24 bp, Homo sapiens
ggacctacacccagcagaaaccaa

SEQ ID NO: 646 - DNA, 24 bp, Homo sapiens
ccggagcccgaccagccaaggacc

SEQ ID NO: 647 - DNA, 24 bp, Homo sapiens
aagcagaacaccggagcccgacca

SEQ ID NO: 648 - DNA, 37 bp, Homo sapiens
gagttcctggtgactcggagcgccatggcttcctctt

SEQ ID NO: 649 - DNA, 23 bp, Homo sapiens
tgactcggagcgccatggcttcc

SEQ ID NO: 650 - DNA, 22 bp, Homo sapiens
gggccgtaggaacgcgctttgc

SEQ ID NO: 651 - DNA, 30 bp, Homo sapiens
ctcagtccgggcttggaggttgcagcaggg

SEQ ID NO: 652 - DNA, 22 bp, Homo sapiens
tccgggcttggaggttgcagca

SEQ ID NO: 653 - DNA, 35 bp, Homo sapiens
ccagcccggcgccctctccctcctgctttccccgg

SEQ ID NO: 654 - DNA, 22 bp, Homo sapiens
ctctccctcctgctttccccgg

SEQ ID NO: 655 - DNA, 22 bp, Homo sapiens
gcccggcgccctctccctcctg

SEQ ID NO: 656 - DNA, 30 bp, Homo sapiens
ccaccccccgacctacctccagcatccagg

SEQ ID NO: 657 - DNA, 22 bp, Homo sapiens
caccccccgacctacctccagc

SEQ ID NO: 658 - DNA, 27 bp, Homo sapiens
ggcacagcagctccatggccagcccgg

SEQ ID NO: 659 - DNA, 22 bp, Homo sapiens
agcagctccatggccagcccgg

SEQ ID NO: 660 - DNA, 28 bp, Homo sapiens
cctgcggaccgggtccacctcgtggcac

SEQ ID NO: 661 - DNA, 22 bp, Homo sapiens
cctgcggaccgggtccacctcg

SEQ ID NO: 662 - DNA, 56 bp, Homo sapiens
gagttgcagatgggacttcggagtcgggaccccagccaagaaacggtccaggtaat

SEQ ID NO: 663 - DNA, 22 bp, Homo sapiens
cgggaccccagccaagaaacgg

SEQ ID NO: 664 - DNA, 22 bp, Homo sapiens
tcggagtcgggaccccagccaa

SEQ ID NO: 665 - DNA, 22 bp, Homo sapiens
gggacttcggagtcgggacccc

SEQ ID NO: 666 - DNA, 23 bp, Homo sapiens
gcggtcagcgggctggtctcttt

SEQ ID NO: 667 - DNA, 22 bp, Homo sapiens
gcggtcagcgggctggtctctt

SEQ ID NO: 668 - DNA, 42 bp, Homo sapiens
gccaggttccacttcaacttccccagcaccaccagttcccac

SEQ ID NO: 669 - DNA, 22 bp, Homo sapiens
tccccagcaccaccagttccca

SEQ ID NO: 670 - DNA, 31 bp, Homo sapiens
acttccagttgcgatcatcgacggtgggtac

SEQ ID NO: 671 - DNA, 25 bp, Homo sapiens
tccagttgcgatcatcgacggtggg

SEQ ID NO: 672 - DNA, 30 bp, Homo sapiens
cagtcagggcatcacaatggagcgagctca

SEQ ID NO: 673 - DNA, 23 bp, Homo sapiens
cagggcatcacaatggagcgagc

SEQ ID NO: 674 - DNA, 27 bp, Homo sapiens
cggtccgggcggtacctccagcatcca

SEQ ID NO: 675 - DNA, 25 bp, Homo sapiens
gcggtccgggcggtacctccagcat

SEQ ID NO: 676 - DNA, 43 bp, Homo sapiens
tcatgtgcaatcacagcagccaggtcccacttgaagcttccct

SEQ ID NO: 677 - DNA, 25 bp, Homo sapiens
gcagccaggtcccacttgagcttcc

SEQ ID NO: 678 - DNA, 25 bp, Homo sapiens
tgtgcaatcacagcagccaggtccc

SEQ ID NO: 679 - DNA, 33 bp, Homo sapiens
gcagagagagccggtgcagaatgaaggccagga

SEQ ID NO: 680 - DNA, 23 bp, Homo sapiens
ccggtgcagaatgaaggccagga

SEQ ID NO: 681 - DNA, 35 bp, Homo sapiens
ggcatgctttttgaccaaggcctgtcggtcacggg

SEQ ID NO: 682 - DNA, 22 bp, Homo sapiens
accaaggcctgtcggtcacggg

SEQ ID NO: 683 - DNA, 41 bp, Homo sapiens
agccccaatgctgcccgtggcgatcatggatggcgggtaca

SEQ ID NO: 684 - DNA, 22 bp, Homo sapiens
cccgtggcgatcatggatggcg

SEQ ID NO: 685 - DNA, 22 bp, Homo sapiens
gccccaatgctgcccgtggcga

SEQ ID NO: 686 - DNA, 32 bp, Homo sapiens
ctcatccccggacatggagcaggcacccaggc

SEQ ID NO: 687 - DNA, 23 bp, Homo sapiens
ccccggacatggagcaggcaccc

SEQ ID NO: 688 - DNA, 28 bp, Homo sapiens
cgctcggctctcgcttctgctgccccgc

SEQ ID NO: 689 - DNA, 22 bp, Homo sapiens
gctctcgcttctgctgccccgc

SEQ ID NO: 690 - DNA, 31 bp, Homo sapiens
gggctgtgggtcctggctgggtccgcgctcg

SEQ ID NO: 691 - DNA, 22 bp, Homo sapiens
tgtgggtcctggctgggtccgc

SEQ ID NO: 692 - DNA, 33 bp, Homo sapiens
cagcacccggtcgttgaggaggttggcatcggg

SEQ ID NO: 693 - DNA, 22 bp, Homo sapiens
cgttgaggaggttggcatcggg

SEQ ID NO: 694 - DNA, 34 bp, Homo sapiens
gctgcaggcggctctttttcacgggctccagcga

SEQ ID NO: 695 - DNA, 22 bp, Homo sapiens
caggcggctctttttcacgggc

SEQ ID NO: 696 - DNA, 26 bp, Homo sapiens
gccaccacgctccccgctgccaccat

SEQ ID NO: 697 - DNA, 22 bp, Homo sapiens
ccacgctccccgctgccaccat

SEQ ID NO: 698 - DNA, 31 bp, Homo sapiens
cactctggagaggaagcgtctgaggcggtag

SEQ ID NO: 699 - DNA, 22 bp, Homo sapiens
ggagaggaagcgtgtgaggcgg

SEQ ID NO: 700 - DNA, 25 bp, Homo sapiens
ccccacgaggagacagtaaccgaac

SEQ ID NO: 701 - DNA, 22 bp, Homo sapiens
ccccacgaggagacagtaaccg

SEQ ID NO: 702 - DNA, 33 bp, Homo sapiens
gaaactccccacacaagagatgaagcccgagag

SEQ ID NO: 703 - DNA, 25 bp, Homo sapiens
tccccacacaagagatgaagcccga

SEQ ID NO: 704 - DNA, 40 bp, Homo sapiens
gggagatgccttggaaatccgctttgttctgtgggttgat

SEQ ID NO: 705 - DNA, 25 bp, Homo sapiens
tgccttggaaatccgctttgttctg

SEQ ID NO: 706 - DNA, 31 bp, Homo sapiens
caaactcttggaggacccgtcgaccacaccg

SEQ ID NO: 707 - DNA, 22 bp, Homo sapiens
ggaggacccgtcgaccacaccg

SEQ ID NO: 708 - DNA, 74 bp, Homo sapiens
ccgcgaaatgacagacactaccgacgccgacataactgcacgcaaggtactccggtccgcgccccaaactcttg

SEQ ID NO: 709 - DNA, 22 bp, Homo sapiens
tccggtccgcgccccaaactct

SEQ ID NO: 710 - DNA, 25 bp, Homo sapiens
gcacgcaaggtactccggtccgcgc

SEQ ID NO: 711 - DNA, 23 bp, Homo sapiens
ccgacgccgacataactgcacgc

SEQ ID NO: 712 - DNA, 33 bp, Homo sapiens
gcaacttcagacgctgcggagtggagctcaagt

SEQ ID NO: 713 - DNA, 25 bp, Homo sapiens
ttcagacgctgcggagtggagctca

SEQ ID NO: 714 - DNA, 37 bp, Homo sapiens
agtaaccgaactgcagcgccccggtcagcagtatata

SEQ ID NO: 715 - DNA, 22 bp, Homo sapiens
tgcagcgccccggtcagcagta

SEQ ID NO: 716 - DNA, 22 bp, Homo sapiens
cgaactgcagcgccccggtcag

SEQ ID NO: 717 - DNA, 23 bp, Homo sapiens
agtaaccgaactgcagcgccccg

SEQ ID NO: 718 - DNA, 23 bp, Homo sapiens
gggagatgccttggaaatccgct

SEQ ID NO: 719 - DNA, 35 bp, Homo sapiens
tgacaacaaggtgcaggatggtgctggcaaagaga

SEQ ID NO: 720 - DNA, 24 bp, Homo sapiens
caaggtgcaggatggtgctggcaa

SEQ ID NO: 721 - DNA, 36 bp, Homo sapiens
cagacactacggacgccgacataactgcacgcaagg

SEQ ID NO: 722 - DNA, 23 bp, Homo sapiens
ccgacgccgacataactgcacgc

SEQ ID NO: 723 - DNA, 24 bp, Homo sapiens
tgacagacactaccgacgccgaca

SEQ ID NO: 724 - DNA, 31 bp, Homo sapiens; identical to SEQ ID NO: 706

SEQ ID NO: 725 - DNA, 22 bp, Homo sapiens
ggaggacccgtcgaccacaccg

SEQ ID NO: 726 - DNA, 42 bp, Homo sapiens
taactgcacgcaaggtactccggtccgcgccccaaactcttg

SEQ ID NO: 727 - DNA, 22 bp, Homo sapiens
ctccggtccgcgccccaaactc

SEQ ID NO: 728 - DNA, 25 bp, Homo sapiens
gcacgcaaggtactccggtccgcgc

SEQ ID NO: 729 - DNA, 34 bp, Homo sapiens
agcaacttcagacgctgcggagtggagctcaagt

SEQ ID NO: 730 - DNA, 23 bp, Homo sapiens
cagacgctgcggagtggagctca

SEQ ID NO: 731 - DNA, 24 bp, Homo sapiens
gcaacttcagacgctgcggagtgg

SEQ ID NO: 732 - DNA, 40 bp, Homo sapiens
agacagtaaccgaactgcagcgccccggtcagcagtatat

SEQ ID NO: 733 - DNA, 23 bp, Homo sapiens
tgcagcgccccggtcagcagtat

SEQ ID NO: 734 - DNA, 24 bp, Homo sapiens
cgaactgcagcgccccggtcagca

SEQ ID NO: 735 - DNA, 22 bp, Homo sapiens
gtaaccgaactgcagcgccccg

SEQ ID NO: 736 - DNA, 22 bp, Homo sapiens
gggagatgccttggaaatccgc

SEQ ID NO: 737 - DNA, 22 bp, Homo sapiens
tgcaggatggtgctggcaaaga

SEQ ID NO: 738 - DNA, 23 bp, Homo sapiens
caaggtgcaggatggtgctggca

SEQ ID NO: 739 - DNA, 40 bp, Homo sapiens
gctgcggcggccgacccccctcctccccactccccccgct

SEQ ID NO: 740 - DNA, 20 bp, Homo sapiens
tcctccccactccccccgct

SEQ ID NO: 741 - DNA, 22 bp, Homo sapiens
gctgcggcggccgacccccctc

SEQ ID NO: 742 - DNA, 46 bp, Homo sapiens
gcttcatgggcctggaacaggaacgcggtccagttggcctccatgg

SEQ ID NO: 743 - DNA, 23 bp, Homo sapiens
cgcggtccagttggcctccatgg

SEQ ID NO: 744 - DNA, 22 bp, Homo sapiens
tgggcctggaacaggaacgcgg

SEQ ID NO: 745 - DNA, 37 bp, Homo sapiens
atggtaagtcatccggtccttcctcttgaagcgctga

SEQ ID NO: 746 - DNA, 25 bp, Homo sapiens
ccggtccttcctcttgaagcgctga

SEQ ID NO: 747 - DNA, 39 bp, Homo sapiens
tgagtgtttctacttgcttccctggccagcttgtcacat

SEQ ID NO: 748 - DNA, 22 bp, Homo sapiens
tgcttccctggccagcttgtca

SEQ ID NO: 749 - DNA, 33 bp, Homo sapiens
cgggtcctctcgggtgggctggtgctggagagc

SEQ ID NO: 750 - DNA, 22 bp, Homo sapiens
cctctcgggtggctggtgctgg

SEQ ID NO: 751 - DNA, 22 bp, Homo sapiens
cgggtcctctcgggtgggctgg

SEQ ID NO: 752 - DNA, 26 bp, Homo sapiens
agctggtggtggctgggtgggatggg

SEQ ID NO: 753 - DNA, 22 bp, Homo sapiens
ggtggtggctgggtgggatggg

SEQ ID NO: 754 - DNA, 31 bp, Homo sapiens
tgctgtgcgggcaggcagcagagtcagcagt

SEQ ID NO: 755 - DNA, 22 bp, Homo sapiens
gcgggcaggcagcagagtcagc

SEQ ID NO: 756 - DNA, 78 bp, Homo sapiens
tccacccaggccttcctgctcacggttcgcaagggtgaggctggctggcctgggcaggaggtgggaagcaggctgctg

SEQ ID NO: 757 - DNA, 22 bp, Homo sapiens
gggcaggaggtgggaagcaggc

SEQ ID NO: 758 - DNA, 22 bp, Homo sapiens
ggctggcctgggcaggaggtgg

SEQ ID NO: 759 - DNA, 22 bp, Homo sapiens
cgcaagggtgaggctggctggc

SEQ ID NO: 760 - DNA, 22 bp, Homo sapiens
ggccttcctgctcacggttcgc

SEQ ID NO: 761 - DNA, 53 bp, Homo sapiens
gcagggtgtgaactgtccatctctccccaccgcctgctccacgccaagcccca

SEQ ID NO: 762 - DNA, 23 bp, Homo sapiens
ccgcctgctccacgccaagcccc

SEQ ID NO: 763 - DNA, 22 bp, Homo sapiens
ccccaccgcctgctccacgcca

SEQ ID NO: 764 - DNA, 24 bp, Homo sapiens
tgtccatctctccccaccgcctgc

SEQ ID NO: 765 - DNA, 54 bp, Homo sapiens
gcggccgcctccgggagccagggaccggccgaggagagtggcggccccggacgg

SEQ ID NO: 766 - DNA, 22 bp, Homo sapiens
ggagagtggcggccccggacgg

SEQ ID NO: 767 - DNA, 24 bp, Homo sapiens
ccagggaccggccgaggagagtgg

SEQ ID NO: 768 - DNA, 22 bp, Homo sapiens
gccgcctccgggagccagggac

SEQ ID NO: 769 - DNA, 22 bp, Homo sapiens
gcatccacgcgcggccgcctcc

SEQ ID NO: 770 - DNA, 25 bp, Homo sapiens
cagagacggcgccggctgcttgagg

SEQ ID NO: 771 - DNA, 22 bp, Homo sapiens
cagagacggcgccggctgcttg

SEQ ID NO: 772 - DNA, 27 bp, Homo sapiens
gctcttcaagccatagggcgccccggg

SEQ ID NO: 773 - DNA, 22 bp, Homo sapiens
tcaagccatagggcgccccggg

SEQ ID NO: 774 - DNA, 26 bp, Homo sapiens
gcttgcggcgtctgcggaggacaatg

SEQ ID NO: 775 - DNA, 22 bp, Homo sapiens
ttgcggcgtctgcggaggacaa

SEQ ID NO: 776 - DNA, 31 bp, Homo sapiens
ccctgaaagctcggctgctgcgtttggtgtt

SEQ ID NO: 777 - DNA, 22 bp, Homo sapiens
gctcggctgctgcgtttggtgt

SEQ ID NO: 778 - DNA, 22 bp, Homo sapiens
ccctgaaagctcggctgctgcg

SEQ ID NO: 779 - DNA, 47 bp, Homo sapiens
catctccatctccagctcctgggctcgccgggcagcctccactctcc

SEQ ID NO: 780 - DNA, 22 bp, Homo sapiens
cgccgggcagcctccactctcc

SEQ ID NO: 781 - DNA, 22 bp, Homo sapiens
ccagctcctgggctcgccgggc

SEQ ID NO: 782 - DNA, 43 bp, Homo sapiens
acggctcatggtcttgagggaggtccgggttttgccattgggc

SEQ ID NO: 783 - DNA, 22 bp, Homo sapiens
ggtccgggttttgccattgggc

SEQ ID NO: 784 - DNA, 24 bp, Homo sapiens
ttgagggaggtccgggttttgcca

SEQ ID NO: 785 - DNA, 43 bp, Homo sapiens
ctggaaagtagaggtcacatcgggtgcggagggagctaaggtt

SEQ ID NO: 786 - DNA, 22 bp, Homo sapiens
tcgggtgcggagggagctaagg

SEQ ID NO: 787 - DNA, 24 bp, Homo sapiens
ggtcacatcgggtgcggagggagc

SEQ ID NO: 788 - DNA, 31 bp, Homo sapiens
ccgtcagaaggcagcagggtgggctaggcaa

SEQ ID NO: 789 - DNA, 22 bp, Homo sapiens
ggcagcagggtgggctaggcaa

SEQ ID NO: 790 - DNA, 23 bp, Homo sapiens
ccccaggctggcagcatgtgctg

SEQ ID NO: 791 - DNA, 22 bp, Homo sapiens
ccccaggctggcagcatgtgct

SEQ ID NO: 792 - DNA, 26 bp, Homo sapiens
ggcctgacctccctgccaggccccag

SEQ ID NO: 793 - DNA, 22 bp, Homo sapiens
tgacctccctgccaggccccag

SEQ ID NO: 794 - DNA, 41 bp, Homo sapiens
ctcaaagaacctctgatgtcccctagcccaggcccagatag

SEQ ID NO: 795 - DNA, 22 bp, Homo sapiens
tgtcccctagcccaggcccaga

SEQ ID NO: 796 - DNA, 34 bp, Homo sapiens
cattatgatgagcccgtttgtcagccgcagattg

SEQ ID NO: 797 - DNA, 22 bp, Homo sapiens
tgagcccgtttgtcagccgcag

SEQ ID NO: 798 - DNA, 35 bp, Homo sapiens
cttgatcagctctcgctttccccttgctgctccag

SEQ ID NO: 799 - DNA, 22 bp, Homo sapiens
tcgctttccccttgctgctcca

SEQ ID NO: 800 - DNA, 36 bp, Homo sapiens
tgaaacctcggttgctcttcgtcgctctccacctcg

SEQ ID NO: 801 - DNA, 22 bp, Homo sapiens
cggttgctcttcgtcgctctcc

SEQ ID NO: 802 - DNA, 28 bp, Homo sapiens
gggtgaacggccacgagggacaccacgc

SEQ ID NO: 803 - DNA, 22 bp, Homo sapiens
acggccacgagggacaccacgc

SEQ ID NO: 804 - DNA, 22 bp, Homo sapiens
cgagcgggttgacggtggaggg

SEQ ID NO: 805 - DNA, 26 bp, Homo sapiens
ctccccgactccagcccgcaagccat

SEQ ID NO: 806 - DNA, 22 bp, Homo sapiens
ccccgactccagcccgcaagcc

SEQ ID NO: 807 - DNA, 42 bp, Homo sapiens
tcattctcgttgaagtcatcgtcctcctcgtcgtcctccccg

SEQ ID NO: 808 - DNA, 22 bp, Homo sapiens
gtcctcctcgtcgtcctccccg

SEQ ID NO: 809 - DNA, 23 bp, Homo sapiens
cgtgccgcccgcccagtgacatg

SEQ ID NO: 810 - DNA, 22 bp, Homo sapiens
cgtgccgcccgcccagtgacat

SEQ ID NO: 811 - DNA, 22 bp, Homo sapiens
gggttgtgggcttcgctcaggc

SEQ ID NO: 812 - DNA, 51 bp, Homo sapiens
nnnnggatccatgggacaggtcacagagtgcaacggtggctgagattcggg

SEQ ID NO: 813 - DNA, 22 bp, Homo sapiens
gcaacggtggctgagattcggg

SEQ ID NO: 814 - DNA, 42 bp, Homo sapiens
ctttagaagaataagccaggtttccacagcatcccccttgag

SEQ ID NO: 815 - DNA, 24 bp, Homo sapiens
agccaggtttccacagcatccccc

SEQ ID NO: 816 - DNA, 30 bp, Homo sapiens
catcctctgcggctggttcattctcctggg

SEQ ID NO: 817 - DNA, 22 bp, Homo sapiens
gcggctggttcattctcctggg

SEQ ID NO: 818 - DNA, 34 bp, Homo sapiens
cccttcccgttggtgacaggcagcgggaacatca

SEQ ID NO: 819 - DNA, 22 bp, Homo sapiens
cgttggtgacaggcagcgggaa

SEQ ID NO: 820 - DNA, 40 bp, Homo sapiens
gggtcaaaggaggagctgctctggtcgccgctgccccagg

SEQ ID NO: 821 - DNA, 22 bp, Homo sapiens
gctgctctggtcgccgctgccc

SEQ ID NO: 822 - DNA, 33 bp, Homo sapiens
cgccccgctcaccgctcttgcctccgagtcccg

SEQ ID NO: 823 - DNA, 22 bp, Homo sapiens
gccccgctcaccgctcttgcct

SEQ ID NO: 824 - DNA, 24 bp, Homo sapiens
gctgccgtctgccgctctccgccg

SEQ ID NO: 825 - DNA, 22 bp, Homo sapiens
tgccgtctgccgctctccgccg

SEQ ID NO: 826 - DNA, 31 bp, Homo sapiens
gggaccttccggaccttcttgggctgcgtgt

SEQ ID NO: 827 - DNA, 22 bp, Homo sapiens
cggaccttcttgggctgcgtgt

SEQ ID NO: 828 - DNA, 31 bp, Homo sapiens
gggtcttggcggacgggtaggcggtggcatc

SEQ ID NO: 829 - DNA, 22 bp, Homo sapiens
tggcggacgggtaggcggtggc

SEQ ID NO: 830 - DNA, 43 bp, Homo sapiens
caggccaccaaacgtgctgctgcttccactgctgcccaccggg

SEQ ID NO: 831 - DNA, 22 bp, Homo sapiens
gcttccactgctgcccaccggg

SEQ ID NO: 832 - DNA, 33 bp, Homo sapiens
ggtcgtcctcgtcctcgtctgggctggtccggg

SEQ ID NO: 833 - DNA, 22 bp, Homo sapiens
tcctcgtctgggctggtccggg

SEQ ID NO: 834 - DNA, 26 bp, Homo sapiens
ggccgcccccatcactccgaaccttg

SEQ ID NO: 835 - DNA, 22 bp, Homo sapiens
gccgcccccatcactccgaacc

SEQ ID NO: 836 - DNA, 42 bp, Homo sapiens
tcaaaaaaacaaaagacccgccgcctgtccccgtctgtctgt

SEQ ID NO: 837 - DNA, 22 bp, Homo sapiens
acccgccgcctgtccccgtctg

SEQ ID NO: 838 - DNA, 44 bp, Homo sapiens
gccaccttgctgacgtcccttcccccaagcccaggtcagtcccc

SEQ ID NO: 839 - DNA, 22 bp, Homo sapiens
ccccaagcccaggtcagtcccc

SEQ ID NO: 840 - DNA, 34 bp, Homo sapiens
ctggttctgcagcagggtcggagccacagcccaa

SEQ ID NO: 841 - DNA, 22 bp, Homo sapiens
gcagcagggtcggagccacagc

SEQ ID NO: 842 - DNA, 30 bp, Homo sapiens
gggaagccaccgagaagggagaggcagccg

SEQ ID NO: 843 - DNA, 24 bp, Homo sapiens
ccaccgagaagggagaggcagccg

SEQ ID NO: 844 - DNA, 23 bp, Homo sapiens
gggcagggcaggagcaaaacaag

SEQ ID NO: 845 - DNA, 21 bp, Homo sapiens
gggcagggcaggagcaaaaca

SEQ ID NO: 846 - DNA, 39 bp, Homo sapiens
ctgcggtgtggcgaagagcagcagctgagggtcgcaggg

SEQ ID NO: 847 - DNA, 22 bp, Homo sapiens
gcagcaggtcagggtcgcaggg

SEQ ID NO: 848 - DNA, 22 bp, Homo sapiens
gcggtgtggcgaagagcagcag

SEQ ID NO: 849 - DNA, 25 bp, Homo sapiens
tgcaccttcagcacctcggcagccc

SEQ ID NO: 850 - DNA, 22 bp, Homo sapiens
gcaccttcagcacctcggcagc

SEQ ID NO: 851 - DNA, 27 bp, Homo sapiens
gggtcaacccctcaagccgtccgccga

SEQ ID NO: 852 - DNA, 22 bp, Homo sapiens
caacccctcaagccgtccgccg

SEQ ID NO: 853 - DNA, 27 bp, Homo sapiens
aggtctctgatgccctcgccctcctcg

SEQ ID NO: 854 - DNA, 22 bp, Homo sapiens
tctgatgccctcgccctcctcg

SEQ ID NO: 855 - DNA, 37 bp, Homo sapiens
cgtcctacacgcccagccagccaaagcctccccacct

SEQ ID NO: 856 - DNA, 22 bp, Homo sapiens
cgcccagccagccaaagcctcc

SEQ ID NO: 857 - DNA, 44 bp, Homo sapiens
cactgcaggagggaccacagggtctgggctgggggaggccttca

SEQ ID NO: 858 - DNA, 22 bp, Homo sapiens
ccccacacccctcctccccttt

SEQ ID NO: 859 - DNA, 29 bp, Homo sapiens
ggccttcaccacccctcctgcccacatca

SEQ ID NO: 860 - DNA, 22 bp, Homo sapiens
gccttcaccacccctcctgccc

SEQ ID NO: 861 - DNA, 27 bp, Homo sapiens
gggttgggaactcagggacgacgggcc

SEQ ID NO: 862 - DNA, 22 bp, Homo sapiens
tgggaactcagggacgacgggc

SEQ ID NO: 863 - DNA, 31 bp, Homo sapiens
tggtgagcagccccagcgaagtgtcataccg

SEQ ID NO: 864 - DNA, 22 bp, Homo sapiens
ggtgagcagccccagcgaagtg

SEQ ID NO: 865 - DNA, 34 bp, Homo sapiens
tgatgctagggtggctgctgctgctgggctgggc

SEQ ID NO: 866 - DNA, 22 bp, Homo sapiens
cggtgctgctgctgggctgggc

SEQ ID NO: 867 - DNA, 36 bp, Homo sapiens
atcgctgatgccctcacccgcctccaagccccacag

SEQ ID NO: 868 - DNA, 22 bp, Homo sapiens
gccctcacccgcctccaagccc

SEQ ID NO: 869 - DNA, 30 bp, Homo sapiens
gggctgtctcgtcccgagggcaccgcgacc

SEQ ID NO: 870 - DNA, 22 bp, Homo sapiens
tcgtcccgagggcaccgcgacc

SEQ ID NO: 871 - DNA, 25 bp, Homo sapiens
ggaccctcccctcctggcccgcggc

SEQ ID NO: 872 - DNA, 22 bp, Homo sapiens
gaccctcccctcctggcccgcg

SEQ ID NO: 873 - DNA, 25 bp, Homo sapiens
ggaccctcccctcctggcccgcggc

SEQ ID NO: 874 - DNA, 22 bp, Homo sapiens
cctttcacacggcccgcggcat

SEQ ID NO: 875 - DNA, 22 bp, Homo sapiens
cgggtgacaggcggcggcggcg

SEQ ID NO: 876 - DNA, 21 bp, Homo sapiens
cgggtgacaggcggcggcggc

SEQ ID NO: 877 - DNA, 26 bp, Homo sapiens
ggtcaacccctcaagccgtccgccga

SEQ ID NO: 878 - DNA, 22 bp, Homo sapiens
caacccctcaagccgtccgccg

SEQ ID NO: 879 - DNA, 38 bp, Homo sapiens
gtcctacacgcccagccagccaaagcctccccacctgg

SEQ ID NO: 880 - DNA, 22 bp, Homo sapiens
cgcccagccagccaaagcctcc

SEQ ID NO: 881 - DNA, 22 bp, Homo sapiens
gctcgatcccgctccgcccccg

SEQ ID NO: 882 - DNA, 21 bp, Homo sapiens
gctcgatcccgctccgccccc

SEQ ID NO: 883 - DNA, 25 bp, Homo sapiens
gtccgccgacgcccactgtggtgtg

SEQ ID NO: 884 - DNA, 22 bp, Homo sapiens
tccgccgacgcccactgtggtg

SEQ ID NO: 885 - DNA, 22 bp, Homo sapiens
gggaggacggccagggacaggg

SEQ ID NO: 886 - DNA, 21 bp, Homo sapiens
gggaggacggccagggacagg

SEQ ID NO: 887 - DNA, 39 bp, Homo sapiens
gccgaaagtgcagttagagcccccccacgcgcacacatg

SEQ ID NO: 888 - DNA, 22 bp, Homo sapiens
agcccccccacgcgcacacatg

SEQ ID NO: 889 - DNA, 40 bp, Homo sapiens
gggccttcagctccttcttctcctcctccgagtggtcagc

SEQ ID NO: 890 - DNA, 22 bp, Homo sapiens
tctcctcctccgagtggtcagc

SEQ ID NO: 891 - DNA, 26 bp, Homo sapiens
ggccgcccccatcactccgaaccttg

SEQ ID NO: 892 - DNA, 22 bp, Homo sapiens
gccgcccccatcactccgaacc

SEQ ID NO: 893 - DNA, 36 bp, Homo sapiens
ctttagaagaataagccaggtttccacagcatcccc

SEQ ID NO: 894 - DNA, 22 bp, Homo sapiens
gccaggtttccacagcatcccc

SEQ ID NO: 895 - DNA, 25 bp, Homo sapiens
cgggccgacgaggagaaagaaaggg

SEQ ID NO: 896 - DNA, 22 bp, Homo sapiens
gccgacgaggagaaagaaaggg

SEQ ID NO: 897 - DNA, 33 bp, Homo sapiens
cttcgttatcgtgttcctgctctcgggccgacg

SEQ ID NO: 898 - DNA, 21 bp, Homo sapiens
tcgtgttcctgctctcgggcc

SEQ ID NO: 899 - DNA, 31 bp, Homo sapiens
catcaagagacgcctgctcctttttgacggt

SEQ ID NO: 900 - DNA, 22 bp, Homo sapiens
gacgcctgctcctttttgacgg

SEQ ID NO: 901 - DNA, 22 bp, Homo sapiens
cctcggtcatctcttggctccc

SEQ ID NO: 902 - DNA, 29 bp, Homo sapiens
gaatgaattcccgtttcctccgacatgca

SEQ ID NO: 903 - DNA, 22 bp, Homo sapiens
ttcccgtttcctccgacatgca

SEQ ID NO: 904 - DNA, 35 bp, Homo sapiens
cgggagcggcgacgggaaggcagcaggaggtggtg

SEQ ID NO: 905 - DNA, 23 bp, Homo sapiens
gcgacgggaaggcagcaggaggt

SEQ ID NO: 906 - DNA, 22 bp, Homo sapiens
cgggagcggcgacgggaaggca

SEQ ID NO: 907 - DNA, 27 bp, Homo sapiens
gctacacacaaagcgcttcagctgcac

SEQ ID NO: 908 - DNA, 24 bp, Homo sapiens
acacacaaagcgcttcagctgcac

SEQ ID NO: 909 - DNA, 22 bp, Homo sapiens
cctcgtacccgccggctgacgc

SEQ ID NO: 910 - DNA, 39 bp, Homo sapiens
atctgttaggttcaccacccctccaggtccaatgataaa

SEQ ID NO: 911 - DNA, 24 bp, Homo sapiens
ggttcaccacccctccaggtccaa

SEQ ID NO: 912 - DNA, 35 bp, Homo sapiens
ccagtgaattcggcggccgcggatccatttattta

SEQ ID NO: 913 - DNA, 22 bp, Homo sapiens
gaattcggcggccgcggatcca

SEQ ID NO: 914 - DNA, 36 bp, Homo sapiens
cggcgcccaaaatccccaccgaaaagtcccccgtcg

SEQ ID NO: 915 - DNA, 23 bp, Homo sapiens
tccccaccgaaaagtcccccgtc

SEQ ID NO: 916 - DNA, 24 bp, Homo sapiens
cggcgcccaaaatccccaccgaaa

SEQ ID NO: 917 - DNA, 35 bp, Homo sapiens; identical to SEQ ID NO: 904

SEQ ID NO: 918 - DNA, 22 bp, Homo sapiens
cgggagcggcgacgggaaggca

SEQ ID NO: 919 - DNA, 23 bp, Homo sapiens
cgggaaggcagcaggaggtggtg

SEQ ID NO: 920 - DNA, 33 bp, Homo sapiens
gaaaagtcccccgtcgtgcgcgcggagggacac

SEQ ID NO: 921 - DNA, 22 bp, Homo sapiens
cgtcgtgcgcgcggagggacac

SEQ ID NO: 922 - DNA, 19 bp, Homo sapiens
gtcccccgtcgtgcgcgcg

SEQ ID NO: 923 - DNA, 26 bp, Homo sapiens
ttttccgaaaatgccgcgtctggtcg

SEQ ID NO: 924 - DNA, 22 bp, Homo sapiens
ccgaaaatgccgcgtctggtcg

SEQ ID NO: 925 - DNA, 24 bp, Homo sapiens
gctgacgcggccccgctacacaca

SEQ ID NO: 926 - DNA, 25 bp, Homo sapiens
cctcgtacccggccgggctgacgcg

SEQ ID NO: 927 - DNA, 23 bp, Homo sapiens
tcgtacccggccgggctgacgcg

SEQ ID NO: 928 - DNA, 35 bp, Homo sapiens
acctctactatgctggcatggccctcagaagctgc

SEQ ID NO: 929 - DNA, 24 bp, Homo sapiens
gctggcatggccctcagaagctgc

SEQ ID NO: 930 - DNA, 30 bp, Homo sapiens
gttaggttcaccacccctccaggtccaatg

SEQ ID NO: 931 - DNA, 24 bp, Homo sapiens
ggttcaccacccctccaggtccaa

SEQ ID NO: 932 - DNA, 32 bp, Homo sapiens
ctgagaacggcagcggcgagggctccacgtgc

SEQ ID NO: 933 - DNA, 22 bp, Homo sapiens
tgagaacggcagcggcgagggc

SEQ ID NO: 934 - DNA, 32 bp, Homo sapiens
gccctgtcgcccccgcccgcactccagagccg

SEQ ID NO: 935 - DNA, 22 bp, Homo sapiens
ccccgcccgcactccagagccg

SEQ ID NO: 936 - DNA, 39 bp, Homo sapiens
tccagagaatttctccccgaggaacccgctgaaaaaaat

SEQ ID NO: 937 - DNA, 22 bp, Homo sapiens
tctccccgaggaacccgctgaa

SEQ ID NO: 938 - DNA, 20 bp, Homo sapiens
cggaatcggcgctgagaagc

SEQ ID NO: 939 - DNA, 33 bp, Homo sapiens
cctatagccttccagtgcagcagcccatcttgt

SEQ ID NO: 940 - DNA, 23 bp, Homo sapiens
gccttccagtgcagcagcccatc

SEQ ID NO: 941 - DNA, 31 bp, Homo sapiens
gcggtggttgtggcgttggcggcgaggcggg

SEQ ID NO: 942 - DNA, 22 bp, Homo sapiens
ttgtggcgttggcggcgaggcg

SEQ ID NO: 943 - DNA, 38 bp, Homo sapiens
atcgatggtacatatgggtggctgagggaggcgttctc

SEQ ID NO: 944 - DNA, 23 bp, Homo sapiens
tgggtggctgagggaggcgttct

SEQ ID NO: 945 - DNA, 29 bp, Homo sapiens
ggccgtcccggagggtcgcatcgctgctc

SEQ ID NO: 946 - DNA, 22 bp, Homo sapiens
ccgtcccggagggtcgcatcgc

SEQ ID NO: 947 - DNA, 25 bp, Homo sapiens
ccaggagcgctgccccggccgtccc

SEQ ID NO: 948 - DNA, 22 bp, Homo sapiens
ccaggagcgctgccccggccgt

SEQ ID NO: 949 - DNA, 29 bp, Homo sapiens
cgaacgcaccggagcccagcactttgatc

SEQ ID NO: 950 - DNA, 22 bp, Homo sapiens
cgaacgcaccggagcccagcac

SEQ ID NO: 951 - DNA, 44 bp, Homo sapiens
cgaggcggcggtggaggtggtggtggcggtggcggcggcagcac

SEQ ID NO: 952 - DNA, 21 bp, Homo sapiens
cgaggcggcggtggaggtggt

SEQ ID NO: 953 - DNA, 22 bp, Homo sapiens
ggtggcggtggcggcggcagca

SEQ ID NO: 954 - DNA, 46 bp, Homo sapiens
ctgtgtgtagcgtggcggtggcgttggcaatgttggcagctccggg

SEQ ID NO: 955 - DNA, 22 bp, Homo sapiens
tggcaatgttggcagctccggg

SEQ ID NO: 956 - DNA, 22 bp, Homo sapiens
agcgtggcggtggcgttggcaa

SEQ ID NO: 957 - DNA, 36 bp, Homo sapiens
gggtactgttaaagagggatgcggaggagtgcggcg

SEQ ID NO: 958 - DNA, 22 bp, Homo sapiens
agggatgcggaggagtgcggcg

SEQ ID NO: 959 - DNA, 25 bp, Homo sapiens
gcccctgcgtttccctacagctcgg

SEQ ID NO: 960 - DNA, 31 bp, Homo sapiens
ccacagccgggccacctcctctgcatccacc

SEQ ID NO: 961 - DNA, 22 bp, Homo sapiens
cagccgggccacctcctctgca

SEQ ID NO: 962 - DNA, 31 bp, Homo sapiens
gcgcggccgcttgtcctctttgttcgggttc

SEQ ID NO: 963 - DNA, 22 bp, Homo sapiens
cgcttgtcctctttgttcgggt

SEQ ID NO: 964 - DNA, 30 bp, Homo sapiens
ggccagcgtgttcttgttgcccgtggcctt

SEQ ID NO: 965 - DNA, 22 bp, Homo sapiens
gccagcgtgttcttgttgcccg

SEQ ID NO: 966 - DNA, 30 bp, Homo sapiens
gccctccttggctgtggtggagtggttgta

SEQ ID NO: 967 - DNA, 22 bp, Homo sapiens
ccttggctgtggtggagtggtt

SEQ ID NO: 968 - DNA, 27 bp, Homo sapiens
catgccccccgccctactcgctgtccg

SEQ ID NO: 969 - DNA, 22 bp, Homo sapiens
cccccgccctactcgctgtccg

SEQ ID NO: 970 - DNA, 38 bp, Homo sapiens
ccctgacattggcttaaacatcactccaggcacaactc

SEQ ID NO: 971 - DNA, 22 bp, Homo sapiens
aacatcactccaggcacaactc

SEQ ID NO: 972 - DNA, 36 bp, Homo sapiens
gggtagttgtacacggcgggcttgctgctgtccagg

SEQ ID NO: 973 - DNA, 22 bp, Homo sapiens
cacggcgggcttgctgctgtcc

SEQ ID NO: 974 - DNA, 31 bp, Homo sapiens
gttggagccgaacgccgcagcctcagacccg

SEQ ID NO: 975 - DNA, 22 bp, Homo sapiens
gaacgccgcagcctcagacccg

SEQ ID NO: 976 - DNA, 39 bp, Homo sapiens
tctccagcagaccccacttcacccctgccctccccatca

SEQ ID NO: 977 - DNA, 22 bp, Homo sapiens
ccacttcacccctgccctcccc

SEQ ID NO: 978 - DNA, 25 bp, Homo sapiens
gggaaaccctctgcctcccccgtga

SEQ ID NO: 979 - DNA, 22 bp, Homo sapiens
aaaccctctgcctcccccgtga

SEQ ID NO: 980 - DNA, 52 bp, Homo sapiens
aaaggaaattgaaggaaatgagctggcaggagtggaggcggtagggaacggg

SEQ ID NO: 981 - DNA, 22 bp, Homo sapiens
ggcaggagtggaggcggtaggg

SEQ ID NO: 982 - DNA, 43 bp, Homo sapiens
ccagattcctgaatccacttccccaccatacctgagcccccca

SEQ ID NO: 983 - DNA, 22 bp, Homo sapiens
ccccaccatacctgagcccccc

SEQ ID NO: 984 - DNA, 25 bp, Homo sapiens
gacgaacgccctccgccagctcctg

SEQ ID NO: 985 - DNA, 22 bp, Homo sapiens
cgaacgccctccgccagctcct

SEQ ID NO: 986 - DNA, 22 bp, Homo sapiens
gagcctgcggtccggtgaagcc

SEQ ID NO: 987 - DNA, 26 bp, Homo sapiens
gccgacacgcgagctctggccccggc

SEQ ID NO: 988 - DNA, 22 bp, Homo sapiens
acacgcgagctctggccccggc

SEQ ID NO: 989 - DNA, 33 bp, Homo sapiens
gggctgcaggaaaggcgacagctgcggcggcgg

SEQ ID NO: 990 - DNA, 22 bp, Homo sapiens
aaggcgacagctgcggcggcgg

SEQ ID NO: 991 - DNA, 29 bp, Homo sapiens
caaagttgctggagacccctgggcgaaca

SEQ ID NO: 992 - DNA, 22 bp, Homo sapiens
ttgctggagacccctgggcgaa

SEQ ID NO: 993 - DNA, 39 bp, Homo sapiens
tttctctgtgagtcatttgtcttgctttggagggaattc

SEQ ID NO: 994 - DNA, 22 bp, Homo sapiens
tgtcttgctttggagggaattc

SEQ ID NO: 995 - DNA, 27 bp, Homo sapiens
gggctgcccaccatcttcccgcctttg

SEQ ID NO: 996 - DNA, 22 bp, Homo sapiens
gctgcccaccatcttcccgcct

SEQ ID NO: 997 - DNA, 56 bp, Homo sapiens
taacaagatgttgacgtctggaaggccatattctttcaccgcccactccagccact

SEQ ID NO: 998 - DNA, 22 bp, Homo sapiens
ctttcaccgcccactccagcca

SEQ ID NO: 999 - DNA, 44 bp, Homo sapiens
gcttatcgtagttcatgttgggtttgctcttccgctctccccag

SEQ ID NO: 1000 - DNA, 22 bp, Homo sapiens
ggtttgctcttccgctctcccc

SEQ ID NO: 1001 - DNA, 38 bp, Homo sapiens
cacaaagttcatcttctgtgggtgggcgtgataggagc

SEQ ID NO: 1002 - DNA, 22 bp, Homo sapiens
tgtgggtgggcgtgataggagc

SEQ ID NO: 1003 - DNA, 58 bp, Homo sapiens
tgaggcacttttgattcatgttctccgatagagtttgtggcgatgggctggtgaatgc

SEQ ID NO: 1004 - DNA, 22 bp, Homo sapiens
gtggcgatgggctggtgaatgc

SEQ ID NO: 1005 - DNA, 26 bp, Homo sapiens
gccgcctacccaaaatgcctgcgtga

SEQ ID NO: 1006 - DNA, 22 bp, Homo sapiens
gccgcctacccaaaatgcctgc

SEQ ID NO: 1007 - DNA, 44 bp, Homo sapiens
atttgtcttgcttttggtcaacacggctttcctcgggtctccaa

SEQ ID NO: 1008 - DNA, 22 bp, Homo sapiens
cacggctttcctcgggtctcca

SEQ ID NO: 1009 - DNA, 23 bp, Homo sapiens
ccaggtgtggcgttccgtaggca

SEQ ID NO: 1010 - DNA, 33 bp, Homo sapiens
gggctgcccaccatcttcccgcctttggccaca

SEQ ID NO: 1011 - DNA, 22 bp, Homo sapiens
gctgcccaccatcttcccgcct

SEQ ID NO: 1012 - DNA, 42 bp, Homo sapiens
ggaaggccatattctttcaccgcccactccagccactgccgc

SEQ ID NO: 1013 - DNA, 22 bp, Homo sapiens
ctttcaccgcccactccagcca

SEQ ID NO: 1014 - DNA, 22 bp, Homo sapiens
cgcccactccagccactgccgc

SEQ ID NO: 1015 - DNA, 47 bp, Homo sapiens
gattcatgttctccgatagagtttgtggcgatgggctggtgaatgca

SEQ ID NO: 1016 - DNA, 22 bp, Homo sapiens
gtggcgatgggctggtgaatgc

SEQ ID NO: 1017 - DNA, 23 bp, Homo sapiens
cttccttccccagccccagtaaa

SEQ ID NO: 1018 - DNA, 22 bp, Homo sapiens
ttccttccccagccccagtaaa

SEQ ID NO: 1019 - DNA, 49 bp, Homo sapiens
tcgcgactcaaaggaaaactggaggccgcctacccaaaatgcctgcgtg

SEQ ID NO: 1020 - DNA, 22 bp, Homo sapiens
gccgcctacccaaaatgcctgc

SEQ ID NO: 1021 - DNA, 90 bp, Homo sapiens
gctccccgcccccgcccccctgagccgccgccgccgccatctccactcccgctgctgctgctgctgctgttgctgccgctgccctctggg

SEQ ID NO: 1022 - DNA, 22 bp, Homo sapiens
gctgctgttgctgccgctgccc

SEQ ID NO: 1023 - DNA, 22 bp, Homo sapiens
ccgccgccatctccactcccgc

SEQ ID NO: 1024 - DNA, 22 bp, Homo sapiens
ccgcccccctgagccgccgccg

SEQ ID NO: 1025 - DNA, 33 bp, Homo sapiens
gcagcagcagcagcagcgggagattgaactggg

SEQ ID NO: 1026 - DNA, 22 bp, Homo sapiens
cgcagcagcagcagcagcggga

SEQ ID NO: 1027 - DNA, 45 bp, Homo sapiens
gagtccctactcagcgccccccaccctccacctctgcccttcagc

SEQ ID NO: 1028 - DNA, 22 bp, Homo sapiens
cccccaccctccacctctgccc

SEQ ID NO: 1029 - DNA, 35 bp, Homo sapiens
atttatatattagacgggtcagggaggtggcaggg

SEQ ID NO: 1030 - DNA, 22 bp, Homo sapiens
acgggtcagggaggtggcaggg

SEQ ID NO: 1031 - DNA, 33 bp, Homo sapiens
gatctggatctcccggagcgtgcgctggcagta

SEQ ID NO: 1032 - DNA, 22 bp, Homo sapiens
tctcccggagcgtgcgctggca

SEQ ID NO: 1033 - DNA, 24 bp, Homo sapiens
ggccaggcccatgctccaccccgg

SEQ ID NO: 1034 - DNA, 22 bp, Homo sapiens
gccaggcccatgctccaccccg

SEQ ID NO: 1035 - DNA, 19 bp, Homo sapiens
gggcgccgggctctccacg

SEQ ID NO: 1036 - DNA, 19 bp, Homo sapiens
gggcgccgggctctccacg

SEQ ID NO: 1037 - DNA, 75 bp, Homo sapiens
cgacgctgaccgggagaggaaggaagacgcgagcgagagctgaagagccgacaccactggaccattcctcgaatt

SEQ ID NO: 1038 - DNA, 22 bp, Homo sapiens
ccactggaccattcctcgaatt

SEQ ID NO: 1039 - DNA, 22 bp, Homo sapiens
gcgagcgagagctgaagagccg

SEQ ID NO: 1040 - DNA, 22 bp, Homo sapiens
ccgggagaggaaggaagacgcg

SEQ ID NO: 1041 - DNA, 41 bp, Homo sapiens
cctcagctcttgtcgcccctcccgcagactgcccgccgccg

SEQ ID NO: 1042 - DNA, 21 bp, Homo sapiens
gcccctcccgcagactgcccg

SEQ ID NO: 1043 - DNA, 22 bp, Homo sapiens
gctcttgtcgcccctcccgcag

SEQ ID NO: 1044 - DNA, 40 bp, Homo sapiens
gcataaaagccacaactaccagaaaccgcccctccaaacg

SEQ ID NO: 1045 - DNA, 22 bp, Homo sapiens
ccagaaaccgcccctccaaacg

SEQ ID NO: 1046 - DNA, 28 bp, Homo sapiens
ggacatccccagaaaccgcccacagctc

SEQ ID NO: 1047 - DNA, 22 bp, Homo sapiens
ccccagaaaccgcccacagctc

SEQ ID NO: 1048 - DNA, 45 bp, Homo sapiens
ggtgtagcgcggccccacgtcgaacacctgcccgcggaccatctc

SEQ ID NO: 1049 - DNA, 22 bp, Homo sapiens
tcgaacacctgcccgcggacca

SEQ ID NO: 1050 - DNA, 22 bp, Homo sapiens
gcgcggccccacgtcgaacacc

SEQ ID NO: 1051 - DNA, 35 bp, Homo sapiens
tggatctgcaacacgggccaggccaaagtcacaga

SEQ ID NO: 1052 - DNA, 22 bp, Homo sapiens
tctgcaacacgggccaggccaa

SEQ ID NO: 1053 - DNA, 44 bp, Homo sapiens
gtcgagagatgaagaccatggcgcgggcgagtgtagggctggcg

SEQ ID NO: 1054 - DNA, 22 bp, Homo sapiens
gcgggcgagtgtagggctggcg

SEQ ID NO: 1055 - DNA, 39 bp, Homo sapiens
cataaaagccacaactaccagaaaccgcccctccaaacg

SEQ ID NO: 1056 - DNA, 22 bp, Homo sapiens
ccagaaaccgcccctccaaacg

SEQ ID NO: 1057 - DNA, 29 bp, Homo sapiens
ggacatccccagaaaccgcccacagctca

SEQ ID NO: 1058 - DNA, 22 bp, Homo sapiens
ccccagaaaccgcccacagcta

SEQ ID NO: 1059 - DNA, 27 bp, Homo sapiens
ccgcggcggcccatcacgaggtcgaga

SEQ ID NO: 1060 - DNA, 22 bp, Homo sapiens
gcggcggcccatcacgaggtcg

SEQ ID NO: 1061 - DNA, 24 bp, Homo sapiens
cgggcatcgctcagggcaatcttc

SEQ ID NO: 1062 - DNA, 22 bp, Homo sapiens
cgggcatcgctcagggcaatct

SEQ ID NO: 1063 - DNA, 25 bp, Homo sapiens
cgcccccgtgtccgccagccccgtg

SEQ ID NO: 1064 - DNA, 22 bp, Homo sapiens
gcccccgtgtccgccagccccg

SEQ ID NO: 1065 - DNA, 35 bp, Homo sapiens
gggtcgtcggcgggcgggctggcgtgctgtgggcg

SEQ ID NO: 1066 - DNA, 22 bp, Homo sapiens
gcgggctggcgtgctctgggcg

SEQ ID NO: 1067 - DNA, 24 bp, Homo sapiens
gcccctccgccctcaccacctttc

SEQ ID NO: 1068 - DNA, 22 bp, Homo sapiens
gcccctccgccctcaccacctt

SEQ ID NO: 1069 - DNA, 28 bp, Homo sapiens
ccaaggcagcagagagggcggaggcggc

SEQ ID NO: 1070 - DNA, 22 bp, Homo sapiens
cagcagagagggcggaggcggc

SEQ ID NO: 1071 - DNA, 45 bp, Homo sapiens
gacattcccctcaaactgcttcccgccccctcctcccaactgcgg

SEQ ID NO: 1072 - DNA, 22 bp, Homo sapiens
cgccccctcctcccaactgcgg

SEQ ID NO: 1073 - DNA, 22 bp, Homo sapiens
ccgcccttccgtcaaactcccc

SEQ ID NO: 1074 - DNA, 34 bp, Homo sapiens
tttctgcccctccctgttcccactccccagccaa

SEQ ID NO: 1075 - DNA, 23 bp, Homo sapiens
gcccctccctgttcccactcccc

SEQ ID NO: 1076 - DNA, 24 bp, Homo sapiens
acgtccgccaagcgtctcttctcg

SEQ ID NO: 1077 - DNA, 36 bp, Homo sapiens
ttctgtcaatcacaggccgccctctgcattcctcag

SEQ ID NO: 1078 - DNA, 22 bp, Homo sapiens
cacaggccgccctctgcattcc

SEQ ID NO: 1079 - DNA, 31 bp, Homo sapiens
tggatgccccagcgccgagcaacctcttccg

SEQ ID NO: 1080 - DNA, 22 bp, Homo sapiens
tggatgccccagcgccgagcaa

SEQ ID NO: 1081 - DNA, 37 bp, Homo sapiens
ctgaattcattcacagcccacatcacccagtcccgaa

SEQ ID NO: 1082 - DNA, 22 bp, Homo sapiens
cagcccacatcacccagtcccg

SEQ ID NO: 1083 - DNA, 34 bp, Homo sapiens
cgaggtatagcgggattctggataggctgggttg

SEQ ID NO: 1084 - DNA, 22 bp, Homo sapiens
gcgggattctggataggctggg

SEQ ID NO: 1085 - DNA, 29 bp, Homo sapiens
cccttgggcttgtggttgggcagggcagc

SEQ ID NO: 1086 - DNA, 22 bp, Homo sapiens
gggcttgtggttgggcagggca

SEQ ID NO: 1087 - DNA, 32 bp, Homo sapiens
cggcttgagatcgacggccgccttcatggtgc

SEQ ID NO: 1088 - DNA, 22 bp, Homo sapiens
tcgacggccgccttcatggtgc

SEQ ID NO: 1089 - DNA, 43 bp, Homo sapiens
actttcctggacattttcaatcctgcctttcctgggtcctcgg

SEQ ID NO: 1090 - DNA, 22 bp, Homo sapiens
cctgcctttcctgggtcctcgg

SEQ ID NO: 1091 - DNA, 37 bp, Homo sapiens
tgagaatctcaaacagccagaaccatcccgtcccacg

SEQ ID NO: 1092 - DNA, 22 bp, Homo sapiens
cagccagaaccatcccgtccca

SEQ ID NO: 1093 - DNA, 41 bp, Homo sapiens
gtttcatcaagacccctaccgccccccgtccttcagctctg

SEQ ID NO: 1094 - DNA, 22 bp, Homo sapiens
ccctaccgccccccgtccttca

SEQ ID NO: 1095 - DNA, 22 bp, Homo sapiens
tcaagacccctaccgccccccg

SEQ ID NO: 1096 - DNA, 40 bp, Homo sapiens
ttttctccgaatgaatggctccgatgctttccctttccca

SEQ ID NO: 1097 - DNA, 23 bp, Homo sapiens
tggctccgatgctttccctttcc

SEQ ID NO: 1098 - DNA, 43 bp, Homo sapiens
caggaggattctttacagatgtcagccacccgtccaaggccac

SEQ ID NO: 1099 - DNA, 22 bp, Homo sapiens
gatgtcagccacccgtccaagg

SEQ ID NO: 1100 - DNA, 30 bp, Homo sapiens
ccaccggcgggccacctttggtgaacatgg

SEQ ID NO: 1101 - DNA, 22 bp, Homo sapiens
ccggcgggccacctttggtgaa

SEQ ID NO: 1102 - DNA, 24 bp, Homo sapiens
cgtcccacggactgccaggcgcca

SEQ ID NO: 1103 - DNA, 22 bp, Homo sapiens
cgtcccacggactgccaggcgc

SEQ ID NO: 1104 - DNA, 23 bp, Homo sapiens
ctcttcccagcttgcccggccac

SEQ ID NO: 1105 - DNA, 22 bp, Homo sapiens
cttcccagcttgcccggccacc

SEQ ID NO: 1106 - DNA, 25 bp, Homo sapiens
gggcaccattttctcgggcggctcc

SEQ ID NO: 1107 - DNA, 41 bp, Homo sapiens
ccttgcgagccgcccccaccactgccgccgttgctcttggg

SEQ ID NO: 1108 - DNA, 22 bp, Homo sapiens
ccccaccactgccgccgttgct

SEQ ID NO: 1109 - DNA, 37 bp, Homo sapiens
caatctgctctcgggtgaaggcggtgcggtaacgacg

SEQ ID NO: 1110 - DNA, 22 bp, Homo sapiens
gctctcgggtgaaggcggtgcg

SEQ ID NO: 1111 - DNA, 24 bp, Homo sapiens
gctgaagggcgaggcggcggcgga

SEQ ID NO: 1112 - DNA, 22 bp, Homo sapiens
gctgaagggcgaggcggcggcg

SEQ ID NO: 1113 - DNA, 29 bp, Homo sapiens
cggggtagagcggcgggtggcggaaggcg

SEQ ID NO: 1114 - DNA, 22 bp, Homo sapiens
agagcggcgggtggcggaaggc

SEQ ID NO: 1115 - DNA, 44 bp, Homo sapiens
gggcgaggagcgaggagcgaggaggcgaggctggctgagtcccg

SEQ ID NO: 1116 - DNA, 22 bp, Homo sapiens
gcgaggaggcgaggctggctga

SEQ ID NO: 1117 - DNA, 22 bp, Homo sapiens
gcgaggagcgaggaggcgaggc

SEQ ID NO: 1118 - DNA, 48 bp, Homo sapiens
ggatcccgctggtccttttccgccctctcctttcccccttggcgtcct

SEQ ID NO: 1119 - DNA, 22 bp, Homo sapiens
ccctctcctttcccccttggcg

SEQ ID NO: 1120 - DNA, 22 bp, Homo sapiens
tcccgctggtccttttccgccc

SEQ ID NO: 1121 - DNA, 31 bp, Homo sapiens
tacttctctccgaccaagcccaaccccgagt

SEQ ID NO: 1122 - DNA, 21 bp, Homo sapiens
ccgaccaagcccaaccccgag

SEQ ID NO: 1123 - DNA, 29 bp, Homo sapiens
ggtggcggccgcgtgcgtcatcatgtagg

SEQ ID NO: 1124 - DNA, 23 bp, Homo sapiens
ggccgcgtgcgtcatcatgtagg

SEQ ID NO: 1125 - DNA, 30 bp, Homo sapiens
cgctcccgccgctgcctccgctgcctccat

SEQ ID NO: 1126 - DNA, 22 bp, Homo sapiens
gctcccgccgctgcctccgctg

SEQ ID NO: 1127 - DNA, 28 bp, Homo sapiens
cgcgccagagccggagccacccagcgcc

SEQ ID NO: 1128 - DNA, 22 bp, Homo sapiens
cgcgccagagccggagccaccc

SEQ ID NO: 1129 - DNA, 30 bp, Homo sapiens
ccttgatggtggtttcgggcaggttgagtg

SEQ ID NO: 1130 - DNA, 22 bp, Homo sapiens
tggtggtttcgggcaggttgag

SEQ ID NO: 1131 - DNA, 33 bp, Homo sapiens
gctgagtttgagggcgtgggcgatctgcgagcg

SEQ ID NO: 1132 - DNA, 22 bp, Homo sapiens
gctgagtttgagggcgtgggcg

SEQ ID NO: 1133 - DNA, 36 bp, Homo sapiens
cccgtagacgtggtgctgcccgcgcgccgctgctcg

SEQ ID NO: 1134 - DNA, 22 bp, Homo sapiens
cgtggtgctgcccgcgcgccgc

SEQ ID NO: 1135 - DNA, 31 bp, Homo sapiens
gctcgctggtgaaggcagtccgccgccgccg

SEQ ID NO: 1136 - DNA, 22 bp, Homo sapiens
ctcgctggtgaaggcagtccgc

SEQ ID NO: 1137 - DNA, 29 bp, Homo sapiens
cattgcctgccttcacccgtttccacttg

SEQ ID NO: 1138 - DNA, 22 bp, Homo sapiens
tgcctgccttcacccgtttcca

SEQ ID NO: 1139 - DNA, 37 bp, Homo sapiens
ctcagggtgtgttccgtgccagtgcccgcccctgagg

SEQ ID NO: 1140 - DNA, 22 bp, Homo sapiens
ccgtgccagtgcccgcccctga

SEQ ID NO: 1141 - DNA, 32 bp, Homo sapiens
ggtccaccaacccgcgggagaagaggcagctc

SEQ ID NO: 1142 - DNA, 22 bp, Homo sapiens
ccaacccgcgggagaagaggca

SEQ ID NO: 1143 - DNA, 22 bp, Homo sapiens
ggtccaccaacccgcgggagaa

SEQ ID NO: 1144 - DNA, 35 bp, Homo sapiens
gtcactcgtaaaccgcttccctcactccccagaag

SEQ ID NO: 1145 - DNA, 22 bp, Homo sapiens
ccgcttccctcactccccagaa

SEQ ID NO: 1146 - DNA, 28 bp, Homo sapiens
gagtccgtcctctcgttcgccgccgccg

SEQ ID NO: 1147 - DNA, 22 bp, Homo sapiens
ccgtcctctcgttcgccgccgc

SEQ ID NO: 1148 - DNA, 42 bp, Homo sapiens
gcattgctgagccccgtccccctccgtgcccacatggtgcgt

SEQ ID NO: 1149 - DNA, 22 bp, Homo sapiens
ccctccgtgcccacatggtgcg

SEQ ID NO: 1150 - DNA, 22 bp, Homo sapiens
tgctgagccccgtccccctccg

SEQ ID NO: 1151 - DNA, 25 bp, Homo sapiens
gggaggagccgagaggagtgtccgc

SEQ ID NO: 1152 - DNA, 22 bp, Homo sapiens
aggagccgagaggagtgtccgc

SEQ ID NO: 1153 - DNA, 24 bp, Homo sapiens
gagcccgctccgagccgccgccgc

SEQ ID NO: 1154 - DNA, 22 bp, Homo sapiens
gagcccgctccgagccgccgcc

SEQ ID NO: 1155 - DNA, 22 bp, Homo sapiens
cccgctggccgctgcacccgag

SEQ ID NO: 1156 - DNA, 23 bp, Homo sapiens
cgcgctcccccggccaacgaccc

SEQ ID NO: 1157 - DNA, 22 bp, Homo sapiens
cgcgctcccccggccaacgacc

SEQ ID NO: 1158 - DNA, 30 bp, Homo sapiens
ctgaccatggtgagcgcgacgcggcctgct

SEQ ID NO: 1159 - DNA, 22 bp, Homo sapiens
tggtgagcgcgacgcggcctgc

SEQ ID NO: 1160 - DNA, 39 bp, Homo sapiens
gcagacagctgagcagcgcgcacagcaggaccccggtgt

SEQ ID NO: 1161 - DNA, 22 bp, Homo sapiens
cagcgcgcacagcaggaccccg

SEQ ID NO: 1162 - DNA, 44 bp, Homo sapiens
gccctcgcagtctcgcaccacccccgtgtcctcgctgtccttgt

SEQ ID NO: 1163 - DNA, 22 bp, Homo sapiens
cgcaccacccccgtgtcctcgc

SEQ ID NO: 1164 - DNA, 22 bp, Homo sapiens
tcgcagtctcgcaccacccccg

SEQ ID NO: 1165 - DNA, 36 bp, Homo sapiens
gcacccacttaccccgctctgcctgcttccctgggt

SEQ ID NO: 1166 - DNA, 22 bp, Homo sapiens
ccgctctgcctgcttccctggg

SEQ ID NO: 1167 - DNA, 41 bp, Homo sapiens
catgaggtcttgctgctgccgccgccggagactacgctggg

SEQ ID NO: 1168 - DNA, 22 bp, Homo sapiens
cgccgccggagactacgctggg

SEQ ID NO: 1169 - DNA, 22 bp, Homo sapiens
ggtcttgctgctgccgccgccg

SEQ ID NO: 1170 - DNA, 29 bp, Homo sapiens
acagctgctgcccttgtggatgccgaaag

SEQ ID NO: 1171 - DNA, 22 bp, Homo sapiens
gctgctgcccttgtggatgccg

SEQ ID NO: 1172 - DNA, 35 bp, Homo sapiens
cagttcagcatgatgtggcgtatggcgggagtggc

SEQ ID NO: 1173 - DNA, 22 bp, Homo sapiens
tgtggcgtatggcgggagtggc

SEQ ID NO: 1174 - DNA, 36 bp, Homo sapiens
ttaccaaggaataatcggcgggcacagggtcaggtg

SEQ ID NO: 1175 - DNA, 22 bp, Homo sapiens
tcggcgggcacagggtcaggtg

SEQ ID NO: 1176 - DNA, 29 bp, Homo sapiens
cgctgcatctccggccgctgcgcgtgggt

SEQ ID NO: 1177 - DNA, 22 bp, Homo sapiens
tctccggccgctgcgcgtgggt

SEQ ID NO: 1178 - DNA, 31 bp, Homo sapiens
gccgtggtgccctcgatgcgtgccttgatgt

SEQ ID NO: 1179 - DNA, 22 bp, Homo sapiens
cgtggtgccctcgatgcgtgcc

SEQ ID NO: 1180 - DNA, 37 bp, Homo sapiens
gcgtggacacgagcatgccccgccggtcatcccacac

SEQ ID NO: 1181 - DNA, 22 bp, Homo sapiens
tgccccgccggtcatcccacac

SEQ ID NO: 1182 - DNA, 22 bp, Homo sapiens
ggacacgagcatgccccgccgg

SEQ ID NO: 1183 - DNA, 26 bp, Homo sapiens
tctgttgggagcgtcgctcgggcacc

SEQ ID NO: 1184 - DNA, 22 bp, Homo sapiens
ttgggagcgtcgctcgggcacc

SEQ ID NO: 1185 - DNA, 42 bp, Homo sapiens
cttcaccagctcgtctcctgccgtggcctccaggatgggtcc

SEQ ID NO: 1186 - DNA, 22 bp, Homo sapiens
tgccgtggcctccaggatgggt

SEQ ID NO: 1187 - DNA, 22 bp, Homo sapiens
cagctcgtctcctgccgtggcc

SEQ ID NO: 1188 - DNA, 35 bp, Homo sapiens
caaacatcttgcagggtgtccagggccgccagtgc

SEQ ID NO: 1189 - DNA, 22 bp, Homo sapiens
tgcagggtgtccagggccgcca

SEQ ID NO: 1190 - DNA, 41 bp, Homo sapiens
ctgtcggcttggcagctcaggagcaccggctggccctctag

SEQ ID NO: 1191 - DNA, 22 bp, Homo sapiens
gctcaggagcaccggctggccc

SEQ ID NO: 1192 - DNA, 22 bp, Homo sapiens
ttggcagctcaggagcaccggc

SEQ ID NO: 1193 - DNA, 22 bp, Homo sapiens
cgcgtgcgctccggccaccaag

SEQ ID NO: 1194 - DNA, 30 bp, Homo sapiens
gccgtggcgccctctttcagcattttcacg

SEQ ID NO: 1195 - DNA, 22 bp, Homo sapiens
gccgtggcgccctctttcagca

SEQ ID NO: 1196 - DNA, 35 bp, Homo sapiens
gaagaggaccctgtcgctgctccccggccgcctcc

SEQ ID NO: 1197 - DNA, 22 bp, Homo sapiens
tcgctgctccccggccgcctcc

SEQ ID NO: 1198 - DNA, 37 bp, Homo sapiens
tccttccgggattttgcagatgggtcggtgggcttcc

SEQ ID NO: 1199 - DNA, 22 bp, Homo sapiens
gcagatgggtcggtgggcttcc

SEQ ID NO: 1200 - DNA, 43 bp, Homo sapiens
gccactggtactgcctgtgtccccctccttggctccttccggg

SEQ ID NO: 1201 - DNA, 22 bp, Homo sapiens
ctgcctgtgtccccctccttgg

SEQ ID NO: 1202 - DNA, 37 bp, Homo sapiens
ggatgggtctccgctgctgctgctactcttgcgatga

SEQ ID NO: 1203 - DNA, 22 bp, Homo sapiens
gatgggtctccgctgctgctgc

SEQ ID NO: 1204 - DNA, 26 bp, Homo sapiens
cgccgccgccgctggagtaggactcg

SEQ ID NO: 1205 - DNA, 22 bp, Homo sapiens
gccgccgccgctggagtaggac

SEQ ID NO: 1206 - DNA, 38 bp, Homo sapiens
tcaccactacagcgcccaccgagccacccccactgcgc

SEQ ID NO: 1207 - DNA, 22 bp, Homo sapiens
cgcccaccgagccacccccact

SEQ ID NO: 1208 - DNA, 33 bp, Homo sapiens
ggccttgtccagccccgccgacgaggacgaggg

SEQ ID NO: 1209 - DNA, 22 bp, Homo sapiens
tccagccccgccgacgaggacg

SEQ ID NO: 1210 - DNA, 28 bp, Homo sapiens
gggtgcgagcgagggtatgggttggaca

SEQ ID NO: 1211 - DNA, 22 bp, Homo sapiens
gggtgcgagcgagggtatgggt

SEQ ID NO: 1212 - DNA, 41 bp, Homo sapiens
cactgcaggtcctggctggtcgtgatggcgttgatggtggg

SEQ ID NO: 1213 - DNA, 22 bp, Homo sapiens
tcctggctggtcgtgatggcgt

SEQ ID NO: 1214 - DNA, 32 bp, Homo sapiens
gggctcctcaccgtagaagcccccagcaatgc

SEQ ID NO: 1215 - DNA, 22 bp, Homo sapiens
ccgtagaagcccccagcaatgc

SEQ ID NO: 1216 - DNA, 29 bp, Homo sapiens
gctctgtcgctgccacccgctcatcttta

SEQ ID NO: 1217 - DNA, 22 bp, Homo sapiens
gctctgtcgctgccacccgctc

SEQ ID NO: 1218 - DNA, 38 bp, Homo sapiens
ccttttgtctactccaagccttccccctgcgtatgtgg

SEQ ID NO: 1219 - DNA, 22 bp, Homo sapiens
actccaagccttccccctgcgt

SEQ ID NO: 1220 - DNA, 22 bp, Homo sapiens
ggcgctcgatttcctgcttgag

SEQ ID NO: 1221 - DNA, 39 bp, Homo sapiens
cgagtcgcctctacttccctggtcaggcgctcgatttcc

SEQ ID NO: 1222 - DNA, 23 bp, Homo sapiens
ccctggtcaggcgctcgatttcc

SEQ ID NO: 1223 - DNA, 33 bp, Homo sapiens
tcaccattcggtcaatcagagctcggcgagtcg

SEQ ID NO: 1224 - DNA, 22 bp, Homo sapiens
tcggtcaatcagagctcggcga

SEQ ID NO: 1225 - DNA, 45 bp, Homo sapiens
gagtcaggttgagaggagcggaaaagggaggagccacgcgggagg

SEQ ID NO: 1226 - DNA, 22 bp, Homo sapiens
aagggaggagccacgcgggagg

SEQ ID NO: 1227 - DNA, 25 bp, Homo sapiens
aggagcggaaaagggaggagccacg

SEQ ID NO: 1228 - DNA, 42 bp, Homo sapiens
gttatcctgccaaccctcagccaaccaccttccgcctcattt

SEQ ID NO: 1229 - DNA, 23 bp, Homo sapiens
ccctcagccaaccaccttccgcc

SEQ ID NO: 1230 - DNA, 54 bp, Homo sapiens
gccacccctcccgccttgcttgctcgctcgctccccggacctcgcctcgccacg

SEQ ID NO: 1231 - DNA, 22 bp, Homo sapiens
ccccggacctcgcctcgccacg

SEQ ID NO: 1232 - DNA, 22 bp, Homo sapiens
tgcttgctcgctcgctccccgg

SEQ ID NO: 1233 - DNA, 23 bp, Homo sapiens
gccacccctcccgccttgcttgc

SEQ ID NO: 1234 - DNA, 39 bp, Homo sapiens
gcggcgtgcgggctgctcctgccacggctagcgcgcggg

SEQ ID NO: 1235 - DNA, 22 bp, Homo sapiens
cctgccacggctagcgcgcggg

SEQ ID NO: 1236 - DNA, 22 bp, Homo sapiens
gcggcgtgcgggctgctcctgc

SEQ ID NO: 1237 - DNA, 24 bp, Homo sapiens
ccgagggagcaagggcgggagttg

SEQ ID NO: 1238 - DNA, 23 bp, Homo sapiens
cgagggagcaagggcgggagttg

SEQ ID NO: 1239 - DNA, 30 bp, Homo sapiens
gggcgtcccgtgagaagtcccgagagtgcc

SEQ ID NO: 1240 - DNA, 22 bp, Homo sapiens
ggcgtcccgtgagaagtcccga

SEQ ID NO: 1241 - DNA, 23 bp, Homo sapiens
gccatcgccgcccccctcgtccg

SEQ ID NO: 1242 - DNA, 23 bp, Homo sapiens
gcccgctcgccccctcccttccg

SEQ ID NO: 1243 - DNA, 35 bp, Homo sapiens
catctctgtcgtcgtcctcgtccgccgccagcagg

SEQ ID NO: 1244 - DNA, 22 bp, Homo sapiens
tcgtcctcgtccgccgccagca

SEQ ID NO: 1245 - DNA, 34 bp, Homo sapiens
ggcagccaccctcctgacccccacctaccacaga

SEQ ID NO: 1246 - DNA, 22 bp, Homo sapiens
ggcagccaccctcctgaccccc

SEQ ID NO: 1247 - DNA, 30 bp, Homo sapiens
acagtcctaaagtgccccacccaagtcgac

SEQ ID NO: 1248 - DNA, 22 bp, Homo sapiens
aaagtgccccacccaagtcgac

SEQ ID NO: 1249 - DNA, 25 bp, Homo sapiens
cgggtcccgcgcgcactcttatccg

SEQ ID NO: 1250 - DNA, 22 bp, Homo sapiens
cgggtcccgcgcgcactcttat

SEQ ID NO: 1251 - DNA, 33 bp, Homo sapiens
cagccactggaggacaaagggccccgctctccg

SEQ ID NO: 1252 - DNA, 22 bp, Homo sapiens
ggacaaagggccccgctctccg

SEQ ID NO: 1253 - DNA, 31 bp, Homo sapiens
cctcgccacgggccgcacgacagtaattggg

SEQ ID NO: 1254 - DNA, 22 bp, Homo sapiens
cgccacgggccgcacgacacta

SEQ ID NO: 1255 - DNA, 34 bp, Homo sapiens
ccgcccgggctcctcctcctgtgccagccgccgc

SEQ ID NO: 1256 - DNA, 22 bp, Homo sapiens
ctcctcctgtgccagccgccgc

SEQ ID NO: 1257 - DNA, 23 bp, Homo sapiens
ccgcccgggctcctcctcctgtg

SEQ ID NO: 1258 - DNA, 26 bp, Homo sapiens
gcagctcaggccctggcgctctccgg

SEQ ID NO: 1259 - DNA, 22 bp, Homo sapiens
gctcaggccctggcgctctccg

SEQ ID NO: 1260 - DNA, 46 bp, Homo sapiens
gtgcaaactttttagcttcctcccctgcaagccttccacagcccgg

SEQ ID NO: 1261 - DNA, 22 bp, Homo sapiens
ctgcaagccttccacagcccgg

SEQ ID NO: 1262 - DNA, 26 bp, Homo sapiens
gctgccagccacgggagccgcacggg

SEQ ID NO: 1263 - DNA, 22 bp, Homo sapiens
gccagccacgggagccgcacgg

SEQ ID NO: 1264 - DNA, 44 bp, Homo sapiens
gctcccgcggccccgtcaccccccatgacccctgcacgcccaag

SEQ ID NO: 1265 - DNA, 22 bp, Homo sapiens
cccccatgacccctgcacgccc

SEQ ID NO: 1266 - DNA, 22 bp, Homo sapiens
gcggccccgtcaccccccatga

SEQ ID NO: 1267 - DNA, 27 bp, Homo sapiens
cccagccaaggcgacctcccgggctgg

SEQ ID NO: 1268 - DNA, 22 bp, Homo sapiens
ccaaggcgacctcccgggctgg

SEQ ID NO: 1269 - DNA, 39 bp, Homo sapiens
agacaggcagaaaagcgacaggaagtggcgcggccgggc

SEQ ID NO: 1270 - DNA, 22 bp, Homo sapiens
cgacaggaagtggcgcggccgg

SEQ ID NO: 1271 - DNA, 26 bp, Homo sapiens
ccagccggcccgggttgctgacgcgc

SEQ ID NO: 1272 - DNA, 23 bp, Homo sapiens
gccggcccgggttgctgacgcgc

SEQ ID NO: 1273 - DNA, 33 bp, Homo sapiens
agctcccgctgcctcccccgctcccacccccag

SEQ ID NO: 1274 - DNA, 22 bp, Homo sapiens
gctcccgctgcctcccccgctc

SEQ ID NO: 1275 - DNA, 61 bp, Homo sapiens
tgctagggtcaggagacacttctttgggtggcgtgggtgggaagccgaaaaggtgggagcc

SEQ ID NO: 1276 - DNA, 22 bp, Homo sapiens
ttgggtggcgtgggtgggaagc

SEQ ID NO: 1277 - DNA, 44 bp, Homo sapiens
tgacacctggtacttgacgccgtccttgtcctctcctcgggctg

SEQ ID NO: 1278 - DNA, 22 bp, Homo sapiens
cgccgtccttgtcctctcctcg

SEQ ID NO: 1279 - DNA, 24 bp, Homo sapiens
ggtgccgtcccgccgccagagagg

SEQ ID NO: 1280 - DNA, 22 bp, Homo sapiens
tgccgtcccgccgccagagagg

SEQ ID NO: 1281 - DNA, 46 bp, Homo sapiens
ggagtgggcaggatgtgtccggagtggctgaagggcgggaggtggc

SEQ ID NO: 1282 - DNA, 22 bp, Homo sapiens
tggctgaagggcgggaggtggc

SEQ ID NO: 1283 - DNA, 31 bp, Homo sapiens
gggtggatgggcgtcggagtgggcaggatgt

SEQ ID NO: 1284 - DNA, 22 bp, Homo sapiens
tggatgggcgtcggagtgggca

SEQ ID NO: 1285 - DNA, 49 bp, Homo sapiens
ccgggcaggcaggagtggtgtcggcttcgggaaatgctgggctgctaag

SEQ ID NO: 1286 - DNA, 22 bp, Homo sapiens
tcgggaaatgctgggctgctaa

SEQ ID NO: 1287 - DNA, 23 bp, Homo sapiens
ccgggcaggcaggagtggtgtcg

SEQ ID NO: 1288 - DNA, 42 bp, Homo sapiens
ggtgcaggctgaggtccccacaaatctgcccccagagccctg

SEQ ID NO: 1289 - DNA, 22 bp, Homo sapiens
ggtccccacaaatctgccccca

SEQ ID NO: 1290 - DNA, 48 bp, Homo sapiens
gccagggtagggatccatgaagcagaggcgggcggcacacctggctcc

SEQ ID NO: 1291 - DNA, 22 bp, Homo sapiens
ggcgggcggcacacctggctcc

SEQ ID NO: 1292 - DNA, 28 bp, Homo sapiens
gctttgccgccgtccagccagggtaggg

SEQ ID NO: 1293 - DNA, 22 bp, Homo sapiens
tttgccgccgtccagccagggt

SEQ ID NO: 1294 - DNA, 40 bp, Homo sapiens
gctggcgtggccccccgacaaggaggaggacgaggccggg

SEQ ID NO: 1295 - DNA, 22 bp, Homo sapiens
ccccccgacaaggaggaggacg

SEQ ID NO: 1296 - DNA, 39 bp, Homo sapiens
gggtgggcgggaaggtgaagaggtgcgggctggcgtggc

SEQ ID NO: 1297 - DNA, 22 bp, Homo sapiens
aagaggtgcgggctggcgtggc

SEQ ID NO: 1298 - DNA, 43 bp, Homo sapiens
cggagctgtactcgggcacgtagggcgggtaggtggtgatggg

SEQ ID NO: 1299 - DNA, 22 bp, Homo sapiens
agggcgggtaggtggtgatggg

SEQ ID NO: 1300 - DNA, 47 bp, Homo sapiens
ggttgccccacagttcacacactccctgccttctgtgctggaccggg

SEQ ID NO: 1301 - DNA, 22 bp, Homo sapiens
ccctgccttctgtgctggaccg

SEQ ID NO: 1302 - DNA, 43 bp, Homo sapiens
caggcgttgcacaggtagtgtcccgtgccatctcgccgccaca

SEQ ID NO: 1303 - DNA, 22 bp, Homo sapiens
gtcccgtgccatctcgccgcca

SEQ ID NO: 1304 - DNA, 37 bp, Homo sapiens
gcatgtggctggagtggctgaagggcgagatgtggct

SEQ ID NO: 1305 - DNA, 22 bp, Homo sapiens
tggctggagtggctgaagggcg

SEQ ID NO: 1306 - DNA, 44 bp, Homo sapiens
atggcgggtgcatcggcgtgggcgtggtcagcatgtggctggag

SEQ ID NO: 1307 - DNA, 22 bp, Homo sapiens
cgggtgcatcggcgtgggcgtg

SEQ ID NO: 1308 - DNA, 24 bp, Homo sapiens
gccgccgccgccgccagggacccg

SEQ ID NO: 1309 - DNA, 20 bp, Homo sapiens
cgccgccgccgccagggacc

SEQ ID NO: 1310 - DNA, 35 bp, Homo sapiens
gcccgcacccgccgctccgccgccactgctgtagg

SEQ ID NO: 1311 - DNA, 22 bp, Homo sapiens
gccgctccgccgccactgctgt

SEQ ID NO: 1312 - DNA, 46 bp, Homo sapiens
ccacaggcgttgcacagatagtgacccgtcccatctcgcctccaga

SEQ ID NO: 1313 - DNA, 22 bp, Homo sapiens
acccgtcccatctcgcctccag

SEQ ID NO: 1314 - DNA, 37 bp, Homo sapiens
catctcctcgctgctgctggtggtggcgttgctggag

SEQ ID NO: 1315 - DNA, 22 bp, Homo sapiens
tgctggtggtggcgttgctgga

SEQ ID NO: 1316 - DNA, 35 bp, Homo sapiens
tctgagaaaatccaacacccgcttcccctaaccag

SEQ ID NO: 1317 - DNA, 22 bp, Homo sapiens
ccaacacccgcttcccctaacc

SEQ ID NO: 1318 - DNA, 27 bp, Homo sapiens
cagtgtgctcgtgctgaagggtgggct

SEQ ID NO: 1319 - DNA, 22 bp, Homo sapiens
tgctcgtgctgaagggtgggct

SEQ ID NO: 1320 - DNA, 23 bp, Homo sapiens
catgcctcaagcggatggatggg

SEQ ID NO: 1321 - DNA, 22 bp, Homo sapiens
atgcctcaagcggatggatggg

SEQ ID NO: 1322 - DNA, 43 bp, Homo sapiens
tccttttatatttcctgcttcattcccccctttgatgcttttt

SEQ ID NO: 1323 - DNA, 22 bp, Homo sapiens
tcctgcttcattcccccctttg

SEQ ID NO: 1324 - DNA, 33 bp, Homo sapiens
ctcctggagccctccttcggagcccctgcctgg

SEQ ID NO: 1325 - DNA, 22 bp, Homo sapiens
gccctccttcggagcccctgcc

SEQ ID NO: 1326 - DNA, 25 bp, Homo sapiens
gggcaagtcgggtttttggcgcaaa

SEQ ID NO: 1327 - DNA, 22 bp, Homo sapiens
gggcaagtcgggtttttggcgc

SEQ ID NO: 1328 - DNA, 35 bp, Homo sapiens
ggattaacatccaaaggctgagcccggaacaaaga

SEQ ID NO: 1329 - DNA, 22 bp, Homo sapiens
tccaaaggctgagcccggaaca

SEQ ID NO: 1330 - DNA, 24 bp, Homo sapiens
ggccactggcccagcggattaaca

SEQ ID NO: 1331 - DNA, 22 bp, Homo sapiens
gccactggcccagcggattaac

SEQ ID NO: 1332 - DNA, 35 bp, Homo sapiens
gcttatatgttgtgggaaccaggaggccggagaga

SEQ ID NO: 1333 - DNA, 22 bp, Homo sapiens
ttgtgggaaccaggaggccgga

SEQ ID NO: 1334 - DNA, 25 bp, Homo sapiens
gggagccagggagacgggagccgga

SEQ ID NO: 1335 - DNA, 22 bp, Homo sapiens
gggagccagggagacgggagcc

SEQ ID NO: 1336 - DNA, 30 bp, Homo sapiens
cctagcgccaccgagggaggaggcgagggc

SEQ ID NO: 1337 - DNA, 22 bp, Homo sapiens
caccgagggaggaggcgagggc

SEQ ID NO: 1338 - DNA, 41 bp, Homo sapiens
cgatccgctttcgcttctccgcccgcactgaggaagagagg

SEQ ID NO: 1339 - DNA, 22 bp, Homo sapiens
ccgctttcgcttctccgcccgc

SEQ ID NO: 1340 - DNA, 22 bp, Homo sapiens
cgcccgcactgaggaagagagg

SEQ ID NO: 1341 - DNA, 38 bp, Homo sapiens
tctgcgatgcagaaggagggctttttgacggcggcggg

SEQ ID NO: 1342 - DNA, 22 bp, Homo sapiens
agggctttttgacggcggcggg

SEQ ID NO: 1343 - DNA, 23 bp, Homo sapiens
cgcggtgagggcggcggcgaggc

SEQ ID NO: 1344 - DNA, 22 bp, Homo sapiens
gcggtgagggcggcggcgaggc

SEQ ID NO: 1345 - DNA, 27 bp, Homo sapiens
cgcttggaaagaggcgtgcgggtgaac

SEQ ID NO: 1346 - DNA, 22 bp, Homo sapiens
tggaaagaggcgtgcgggtgaa

SEQ ID NO: 1347 - DNA, 42 bp, Homo sapiens
ctgctgttgttgttgcgggtgatggtggtggtaggcggctga

SEQ ID NO: 1348 - DNA, 22 bp, Homo sapiens
cgggtgatggtggtggtaggcg

SEQ ID NO: 1349 - DNA, 48 bp, Homo sapiens
gggcggaggcggaggctgttctctgcgcggctgttgctgctgctgttg

SEQ ID NO: 1350 - DNA, 22 bp, Homo sapiens
gcggctgttgctgctgctgttg

SEQ ID NO: 1351 - DNA, 22 bp, Homo sapiens
gggcggaggcggaggctgttct

SEQ ID NO: 1352 - DNA, 29 bp, Homo sapiens
gggctcctctcgtcctgctcgccatccgc

SEQ ID NO: 1353 - DNA, 22 bp, Homo sapiens
tctcgtcctgctcgccatccgc

SEQ ID NO: 1354 - DNA, 49 bp, Homo sapiens
tttggtgcagagaacgctcactcccctcagtccgctccgtgtcgctggg

SEQ ID NO: 1355 - DNA, 22 bp, Homo sapiens
ccctcagtccgctccgtgtcgc

SEQ ID NO: 1356 - DNA, 27 bp, Homo sapiens
ccagcactgctggcggtaatgagggcg

SEQ ID NO: 1357 - DNA, 22 bp, Homo sapiens
actgctggcggtaatgagggcg

SEQ ID NO: 1358 - DNA, 49 bp, Homo sapiens
gctgaagctgaaactattgccgccgccgccgctgctcccaccactccca

SEQ ID NO: 1359 - DNA, 24 bp, Homo sapiens
aaactattgccgccgccgccgctg

SEQ ID NO: 1360 - DNA, 28 bp, Homo sapiens
agcgctgctggctgtgggctgtgttgca

SEQ ID NO: 1361 - DNA, 22 bp, Homo sapiens
cgctgctggctgtgggctgtgt

SEQ ID NO: 1362 - DNA, 46 bp, Homo sapiens
ggaggtaggctccacgctgcgtctcctgccctaccaagtcgccaac

SEQ ID NO: 1363 - DNA, 22 bp, Homo sapiens
tcctgccctaccaagtcgccaa

SEQ ID NO: 1364 - DNA, 26 bp, Homo sapiens
gcgccaggcgccccccactttttttt

SEQ ID NO: 1365 - DNA, 22 bp, Homo sapiens
cgccaggcgccccccacttttt

SEQ ID NO: 1366 - DNA, 33 bp, Homo sapiens
gggtcgggaagtcaagcggcatcaacaccaggc

SEQ ID NO: 1367 - DNA, 22 bp, Homo sapiens
tcaagcggcatcaacaccaggc

SEQ ID NO: 1368 - DNA, 22 bp, Homo sapiens
gggtcgggaagtcaagcggcat

SEQ ID NO: 1369 - DNA, 31 bp, Homo sapiens
aggtctcacccctcccccacacgcacacttc

SEQ ID NO: 1370 - DNA, 22 bp, Homo sapiens
tcacccctcccccacacgcaca

SEQ ID NO: 1371 - DNA, 35 bp, Homo sapiens
tgggaaggccccgcattttcaggtgtgtgtgcggg

SEQ ID NO: 1372 - DNA, 22 bp, Homo sapiens
gccccgcattttcaggtgtgtg

SEQ ID NO: 1373 - DNA, 24 bp, Homo sapiens
tggtgtttcccaacgcctccctgc

SEQ ID NO: 1374 - DNA, 22 bp, Homo sapiens
gtgtttcccaagccctccctgc

SEQ ID NO: 1375 - DNA, 22 bp, Homo sapiens
cggacggcgggcactggcaacc

SEQ ID NO: 1376 - DNA, 23 bp, Homo sapiens
ggcctctgcccgccctcccctgg

SEQ ID NO: 1377 - DNA, 22 bp, Homo sapiens
gcctctgcccgccctcccctgg

SEQ ID NO: 1378 - DNA, 37 bp, Homo sapiens
tttgccaataatcaaagtcgccgccggaaactcagcc

SEQ ID NO: 1379 - DNA, 22 bp, Homo sapiens
ccaataatcaaagtcgccgccg

SEQ ID NO: 1380 - DNA, 23 bp, Homo sapiens
cgcggagtcagtgcgtgcggtgc

SEQ ID NO: 1381 - DNA, 22 bp, Homo sapiens
gcggagtcagtgcgtgcggtgc

SEQ ID NO: 1382 - DNA, 43 bp, Homo sapiens
ggccgtcgatgccgctagtcccgccgctcgccccgccgccgcc

SEQ ID NO: 1383 - DNA, 22 bp, Homo sapiens
agtcccgccgctcgccccgccg

SEQ ID NO: 1384 - DNA, 27 bp, Homo sapiens
ggccccccgtgcccgccgcccgtgccg

SEQ ID NO: 1385 - DNA, 22 bp, Homo sapiens
cccgtgcccgccgcccgtgccg

SEQ ID NO: 1386 - DNA, 40 bp, Homo sapiens
gatctcagtctcacacctccaactgccccttcccgttaag

SEQ ID NO: 1387 - DNA, 22 bp, Homo sapiens
cacctccaactgccccttcccg

SEQ ID NO: 1388 - DNA, 44 bp, Homo sapiens
ccaagttcctttccccggtgataagccctgacccccattcccgg

SEQ ID NO: 1389 - DNA, 22 bp, Homo sapiens
taagccctgacccccattcccg

SEQ ID NO: 1390 - DNA, 35 bp, Homo sapiens
ggcccacgccccctgctttagtcaaacaaggcccc

SEQ ID NO: 1391 - DNA, 22 bp, Homo sapiens
tgctttagtcaaacaaggcccc

SEQ ID NO: 1392 - DNA, 22 bp, Homo sapiens
gcccacgccccctgctttagtc

SEQ ID NO: 1393 - DNA, 33 bp, Homo sapiens
aagggagagagggaaagagggagggaggaagga

SEQ ID NO: 1394 - DNA, 22 bp, Homo sapiens
gggaaagagggagggaggaagg

SEQ ID NO: 1395 - DNA, 31 bp, Homo sapiens
actccccaaggaatgcggactcaggaccacc

SEQ ID NO: 1396 - DNA, 22 bp, Homo sapiens
ccccaaggaatgcggactcagg

SEQ ID NO: 1397 - DNA, 41 bp, Homo sapiens
ggctccggtcctcgccccagcccctcccgttgctgcttgta

SEQ ID NO: 1398 - DNA, 22 bp, Homo sapiens
tcgccccagcccctcccgttgc

SEQ ID NO: 1399 - DNA, 22 bp, Homo sapiens
gcccctcccgttgctgcttgta

SEQ ID NO: 1400 - DNA, 30 bp, Homo sapiens
agctgctggctggtgaaggcggtgcgcggc

SEQ ID NO: 1401 - DNA, 22 bp, Homo sapiens
gctggctggtgaaggcggtgcg

SEQ ID NO: 1402 - DNA, 31 bp, Homo sapiens
gcagcgctagatgcctcagaccgcccgtggg

SEQ ID NO: 1403 - DNA, 22 bp, Homo sapiens
agatgcctcagaccgcccgtgg

SEQ ID NO: 1404 - DNA, 32 bp, Homo sapiens
ccgtctgcggaggaagggtcagggcagctggc

SEQ ID NO: 1405 - DNA, 22 bp, Homo sapiens
gcggaggaagggtcagggcagc

SEQ ID NO: 1406 - DNA, 48 bp, Homo sapiens
ctcgtagcttcctcctccccgcaaccccccactcagcagcaaacccca

SEQ ID NO: 1407 - DNA, 22 bp, Homo sapiens
ccgcaaccccccactcagcagc

SEQ ID NO: 1408 - DNA, 41 bp, Homo sapiens
ggttctggaaccaaatcttcacctgcgggcacaagcgggcg

SEQ ID NO: 1409 - DNA, 22 bp, Homo sapiens
aaccaaatcttcacctgcgggc

SEQ ID NO: 1410 - DNA, 35 bp, Homo sapiens
gcgcccccgccgccgcccttctgtttctccgcttc

SEQ ID NO: 1411 - DNA, 22 bp, Homo sapiens
ccgccgccgcccttctgtttct

SEQ ID NO: 1412 - DNA, 40 bp, Homo sapiens
ggaaatggtcctcgtcgtcctcgtcctcgtcctcctcggg

SEQ ID NO: 1413 - DNA, 22 bp, Homo sapiens
cctcgtcctcgtcctcctcggg

SEQ ID NO: 1414 - DNA, 31 bp, Homo sapiens
cgaggagcagtcggaggaggcggcgtggacg

SEQ ID NO: 1415 - DNA, 22 bp, Homo sapiens
gcagtcggaggaggcggcgtgg

SEQ ID NO: 1416 - DNA, 31 bp, Homo sapiens
cgcactcgcgcctcccccaacaccaaccaaa

SEQ ID NO: 1417 - DNA, 22 bp, Homo sapiens
cgcctcccccaacaccaaccaa

SEQ ID NO: 1418 - DNA, 40 bp, Homo sapiens
tttgaacgctcgtgacataatccccccgaccccagagacg

SEQ ID NO: 1419 - DNA, 22 bp, Homo sapiens
aatccccccgaccccagagacg

SEQ ID NO: 1420 - DNA, 42 bp, Homo sapiens
tccgattttcaccctcagctgccaaccgccgagtagacaccc

SEQ ID NO: 1421 - DNA, 22 bp, Homo sapiens
caccctcagctgccaaccgccg

SEQ ID NO: 1422 - DNA, 22 bp, Homo sapiens
gccaaccgccgagtagacaccc

SEQ ID NO: 1423 - DNA, 27 bp, Homo sapiens
ggattctcccgcctcagcctcccgagt

SEQ ID NO: 1424 - DNA, 22 bp, Homo sapiens
ttctcccgcctcagcctcccga

SEQ ID NO: 1425 - DNA, 34 bp, Homo sapiens
gacagttttgctcgtcggtcgcccaggctggagg

SEQ ID NO: 1426 - DNA, 22 bp, Homo sapiens
tgctcgtcggtcgcccaggctg

SEQ ID NO: 1427 - DNA, 35 bp, Homo sapiens
ggaagtccttgcatcctcctacccccagccctgga

SEQ ID NO: 1428 - DNA, 23 bp, Homo sapiens
ttgcatcctcctacccccagccc

SEQ ID NO: 1429 - DNA, 34 bp, Homo sapiens
gggtttggcataggaggctggtgggcgacggcag

SEQ ID NO: 1430 - DNA, 22 bp, Homo sapiens
aggaggctggtgggcgacggca

SEQ ID NO: 1431 - DNA, 35 bp, Homo sapiens
cccaggcaaccaggcggcagcggtccaggttaccc

SEQ ID NO: 1432 - DNA, 23 bp, Homo sapiens
ggcggcagcggtccaggttaccc

SEQ ID NO: 1433 - DNA, 22 bp, Homo sapiens
cccaggcaaccaggcggcagcg

SEQ ID NO: 1434 - DNA, 33 bp, Homo sapiens
agggtcccgcctcatccgcccccgccctacccg

SEQ ID NO: 1435 - DNA, 22 bp, Homo sapiens
tcatccgcccccgccctacccg

SEQ ID NO: 1436 - DNA, 22 bp, Homo sapiens
cccgcctcatccgcccccgccc

SEQ ID NO: 1437 - DNA, 22 bp, Homo sapiens
cccaggctcacaggctccccgc

SEQ ID NO: 1438 - DNA, 36 bp, Homo sapiens
ctgcacgtccgcccccgccccgccccgctccgcccg

SEQ ID NO: 1439 - DNA, 24 bp, Homo sapiens
tactgcacgtccgcccccgccccg

SEQ ID NO: 1440 - DNA, 44 bp, Homo sapiens
gcatggagcgacggcacccaccagcacaccgccggcgcccccag

SEQ ID NO: 1441 - DNA, 22 bp, Homo sapiens
cagcacaccgccggcgccccca

SEQ ID NO: 1442 - DNA, 22 bp, Homo sapiens
gcacccaccagcacaccgccgg

SEQ ID NO: 1443 - DNA, 22 bp, Homo sapiens
ggagcgacggcacccaccagca

SEQ ID NO: 1444 - DNA, 29 bp, Homo sapiens
gcgcccccgcaccgttcacctcgcacttc

SEQ ID NO: 1445 - DNA, 22 bp, Homo sapiens
cgcccccgcaccgttcacctcg

SEQ ID NO: 1446 - DNA, 39 bp, Homo sapiens
cgatgtcaatggtctggaagcggcggctgtacctgcgta

SEQ ID NO: 1447 - DNA, 22 bp, Homo sapiens
ggaagcggcggctgtacctgcg

SEQ ID NO: 1448 - DNA, 22 bp, Homo sapiens
tcaatggtctggaagcggcggc

SEQ ID NO: 1449 - DNA, 37 bp, Homo sapiens
tcatagatgaaaacccccccgagacagcagcactgca

SEQ ID NO: 1450 - DNA, 23 bp, Homo sapiens
ccccccgagacagcagcactgca

SEQ ID NO: 1451 - DNA, 45 bp, Homo sapiens
ctccctcctccctgtctccaaagcggcaccgccctcgtgcggttt

SEQ ID NO: 1452 - DNA, 23 bp, Homo sapiens
tccaaagcggcaccgccctcgtg

SEQ ID NO: 1453 - DNA, 24 bp, Homo sapiens
cctgtctccaaagcggcaccgccc

SEQ ID NO: 1454 - DNA, 40 bp, Homo sapiens
ctccttttaactggccggcgggtcacgtggcacaggcagt

SEQ ID NO: 1455 - DNA, 22 bp, Homo sapiens
cggcgggtcacgtggcacaggc

SEQ ID NO: 1456 - DNA, 22 bp, Homo sapiens
aactggccggcgggtcacgtgg

SEQ ID NO: 1457 - DNA, 34 bp, Homo sapiens
ggcgcaattgtccaagaagccagcggagcgcccc

SEQ ID NO: 1458 - DNA, 22 bp, Homo sapiens
ccaagaagccagcggagcgccc

SEQ ID NO: 1459 - DNA, 49 bp, Homo sapiens
gcatacaccgactgggccgccgccgccgccgctagccgagcagcacaca

SEQ ID NO: 1460 - DNA, 22 bp, Homo sapiens
cgccgccgctagccgagcagca

SEQ ID NO: 1461 - DNA, 22 bp, Homo sapiens
atacaccgactgggccgccgcc

SEQ ID NO: 1462 - DNA, 40 bp, Homo sapiens
cgataagtagtaccttgccccgcagggagcccaggctcac

SEQ ID NO: 1463 - DNA, 22 bp, Homo sapiens
ttgccccgcagggagcccaggc

SEQ ID NO: 1464 - DNA, 24 bp, Homo sapiens
gggtccgaggcgccgctgcagctc

SEQ ID NO: 1465 - DNA, 23 bp, Homo sapiens
ggtccgaggcgccgctgcagctc

SEQ ID NO: 1466 - DNA, 38 bp, Homo sapiens
ccagcactttgggaggccgaggcgggtggatcacgagg

SEQ ID NO: 1467 - DNA, 22 bp, Homo sapiens
ttgggaggccgaggcgggtgga

SEQ ID NO: 1468 - DNA, 24 bp, Homo sapiens
ggccgaggcgggtggatcacgagg

SEQ ID NO: 1469 - DNA, 32 bp, Homo sapiens
acctgcgccgcgccacaccgggagacaagaag

SEQ ID NO: 1470 - DNA, 22 bp, Homo sapiens
cgcgccacaccgggagacaaga

SEQ ID NO: 1471 - DNA, 22 bp, Homo sapiens
tcacctgcgccgcgccacaccg

SEQ ID NO: 1472 - DNA, 34 bp, Homo sapiens
ggcccttgcccaaatgttgccgccctgagtcccg

SEQ ID NO: 1473 - DNA, 22 bp, Homo sapiens
aatgttgccgccctgagtcccg

SEQ ID NO: 1474 - DNA, 22 bp, Homo sapiens
gcccttgcccaaatgttgccgc

SEQ ID NO: 1475 - DNA, 29 bp, Homo sapiens
gggagccagggagacgggagccggacacc

SEQ ID NO: 1476 - DNA, 22 bp, Homo sapiens
ggagccagggagacgggagccg

SEQ ID NO: 1477 - DNA, 36 bp, Homo sapiens
cctagcgccaccgagggaggaggcgagggccggatc

SEQ ID NO: 1478 - DNA, 22 bp, Homo sapiens
cgagggaggaggcgagggccgg

SEQ ID NO: 1479 - DNA, 23 bp, Homo sapiens
ccaccgagggaggaggcgagggc

SEQ ID NO: 1480 - DNA, 23 bp, Homo sapiens
cctagcgccaccgagggaggagg

SEQ ID NO: 1481 - DNA, 30 bp, Homo sapiens
gatccgctttcgcttctccgcccgcactga

SEQ ID NO: 1482 - DNA, 22 bp, Homo sapiens
ccgctttcgcttctccgcccgc

SEQ ID NO: 1483 - DNA, 33 bp, Homo sapiens
gatgcagaaggagggctttttgacggcggcggg

SEQ ID NO: 1484 - DNA, 22 bp, Homo sapiens
ggagggctttttgacggcggcg

SEQ ID NO: 1485 - DNA, 39 bp, Homo sapiens
ttgcgggtgatggtggtggtaggcggctgggagcggaga

SEQ ID NO: 1486 - DNA, 22 bp, Homo sapiens
ggtggtaggcggctgggagcgg

SEQ ID NO: 1487 - DNA, 23 bp, Homo sapiens
gggtgatggtggtggtaggcggc

SEQ ID NO: 1488 - DNA, 42 bp, Homo sapiens
gggcggaggcggaggctgttgctgctgcggctgttgctgctg

SEQ ID NO: 1489 - DNA, 22 bp, Homo sapiens
ttgctgctgcggctgttgctgc

SEQ ID NO: 1490 - DNA, 22 bp, Homo sapiens
cggaggctgttgctgctgcggc

SEQ ID NO: 1491 - DNA, 22 bp, Homo sapiens
gggcggaggcggaggctgttgc

SEQ ID NO: 1492 - DNA, 30 bp, Homo sapiens
gcctgcagcctcccgcccaagacctacctc

SEQ ID NO: 1493 - DNA, 23 bp, Homo sapiens
gcctcccgcccaagacctacctc

SEQ ID NO: 1494 - DNA, 22 bp, Homo sapiens
gcctgcagcctcccgcccaaga

SEQ ID NO: 1495 - DNA, 40 bp, Homo sapiens
aggaaatgttagcctcacccctccaccacatctccggatc

SEQ ID NO: 1496 - DNA, 23 bp, Homo sapiens
cccctccaccacatctaaggatc

SEQ ID NO: 1497 - DNA, 30 bp, Homo sapiens
gctacaaaacaggctgcctcccgaaacccg

SEQ ID NO: 1498 - DNA, 22 bp, Homo sapiens
acaggctgcctcccgaaacccg

SEQ ID NO: 1499 - DNA, 43 bp, Homo sapiens
ggcccaactcagcaccgcgtccgcctcgtgcctcccaggagat

SEQ ID NO: 1500 - DNA, 22 bp, Homo sapiens
ccgcgtccgcctcgtgcctccc

SEQ ID NO: 1501 - DNA, 23 bp, Homo sapiens
gcccaactcagcaccgcgtccgc

SEQ ID NO: 1502 - DNA, 32 bp, Homo sapiens
cggagcgcgctttggcccctttgctccccttc

SEQ ID NO: 1503 - DNA, 22 bp, Homo sapiens
cggagcgcgctttggccccttt

SEQ ID NO: 1504 - DNA, 22 bp, Homo sapiens
gctctgcaaagcccgcctcccg

SEQ ID NO: 1505 - DNA, 43 bp, Homo sapiens
ccacgccccggccacgccaaagtttttgctgcggccgcgtggg

SEQ ID NO: 1506 - DNA, 22 bp, Homo sapiens
gtttttgctgcggccgcgtggg

SEQ ID NO: 1507 - DNA, 22 bp, Homo sapiens
ccacgccccggccacgccaaag

SEQ ID NO: 1508 - DNA, 29 bp, Homo sapiens
gggagccagggagacgggagccggacacc

SEQ ID NO: 1509 - DNA, 22 bp, Homo sapiens
agccagggagacgggagccgga

SEQ ID NO: 1510 - DNA, 22 bp, Homo sapiens
gcgggctggaggagagcgaggg

SEQ ID NO: 1511 - DNA, 36 bp, Homo sapiens
gccggtcaccgcctcgctccctggcctcgctttaaa

SEQ ID NO: 1512 - DNA, 22 bp, Homo sapiens
cctcgctccctggcctcgcttt

SEQ ID NO: 1513 - DNA, 22 bp, Homo sapiens
gccggtcaccgcctcgctccct

SEQ ID NO: 1514 - DNA, 27 bp, Homo sapiens
ggcggcagccgaggacgatccgctttc

SEQ ID NO: 1515 - DNA, 22 bp, Homo sapiens
ggcagccgaggacgatccgctt

SEQ ID NO: 1516 - DNA, 21 bp, Homo sapiens
ggcggcagccgaggacgatcc

SEQ ID NO: 1517 - DNA, 23 bp, Homo sapiens
ggcgcgcgagtcccggagaaggc

SEQ ID NO: 1518 - DNA, 22 bp, Homo sapiens
ggcgcgcgagtcccggagaagg

SEQ ID NO: 1519 - DNA, 24 bp, Homo sapiens
ccagcccggctgcgaacatcctgc

SEQ ID NO: 1520 - DNA, 22 bp, Homo sapiens
agcccggctgcgaacatcctgc

SEQ ID NO: 1521 - DNA, 24 bp, Homo sapiens
gcttggaaagaggcgtgcgggtga

SEQ ID NO: 1522 - DNA, 22 bp, Homo sapiens
ttggaaagaggcgtgcgggtga

SEQ ID NO: 1523 - DNA, 28 bp, Homo sapiens
cgggacttcggagggcgccaccactggg

SEQ ID NO: 1524 - DNA, 22 bp, Homo sapiens
ttcggagggcgccaccactggg

SEQ ID NO: 1525 - DNA, 22 bp, Homo sapiens
cgggacttcggagggcgccacc

SEQ ID NO: 1526 - DNA, 39 bp, Homo sapiens
ctccgctgatttgttcctccccttccccttgccctggat

SEQ ID NO: 1527 - DNA, 22 bp, Homo sapiens
cctccccttccccttgccctgg

SEQ ID NO: 1528 - DNA, 28 bp, Homo sapiens
gcctgagaggtgcaccccggcgggccgc

SEQ ID NO: 1529 - DNA, 22 bp, Homo sapiens
gagaggtgcaccccggcgggcc

SEQ ID NO: 1530 - DNA, 37 bp, Homo sapiens
tgggatctagagatgcgaagaactggccggccgaggg

SEQ ID NO: 1531 - DNA, 22 bp, Homo sapiens
cgaagaactggccggccgaggg

SEQ ID NO: 1532 - DNA, 23 bp, Homo sapiens
cgcagaacgggagccagagggaa

SEQ ID NO: 1533 - DNA, 22 bp, Homo sapiens
cgcagaacgggagccagaggga

SEQ ID NO: 1534 - DNA, 36 bp, Homo sapiens
gcccagcatcgccgccagctgctttcggtccggctt

SEQ ID NO: 1535 - DNA, 22 bp, Homo sapiens
cgccagctgctttcggtccggc

SEQ ID NO: 1536 - DNA, 22 bp, Homo sapiens
gcatcgccgccagctgctttcg

SEQ ID NO: 1537 - DNA, 20 bp, Homo sapiens
gcccagcatcgccgccagct

SEQ ID NO: 1538 - DNA, 26 bp, Homo sapiens
ccgcccgagggcctgtgcgctggagc

SEQ ID NO: 1539 - DNA, 22 bp, Homo sapiens
ccgagggcctgtgcgctggagc

SEQ ID NO: 1540 - DNA, 35 bp, Homo sapiens
tggccttaacaacccccagcaaagccaagcgcctt

SEQ ID NO: 1541 - DNA, 22 bp, Homo sapiens
cccccagcaaagccaagcgcct

SEQ ID NO: 1542 - DNA, 31 bp, Homo sapiens
gggccaggagacgcaccccgacaccttggcc

SEQ ID NO: 1543 - DNA, 22 bp, Homo sapiens
ggccaggagacgcaccccgaca

SEQ ID NO: 1544 - DNA, 22 bp, Homo sapiens
gacgcaccccgacaccttggcc

SEQ ID NO: 1545 - DNA, 34 bp, Homo sapiens
gcgccccgagccaatcccgagccagagtttccgc

SEQ ID NO: 1546 - DNA, 22 bp, Homo sapiens
cgccccgagccaatcccgagcc

SEQ ID NO: 1547 - DNA, 37 bp, Homo sapiens
gcgccaccaccaccgccgcctgcctcgcctctgcccg

SEQ ID NO: 1548 - DNA, 22 bp, Homo sapiens
accgccgcctgcctcgcctctg

SEQ ID NO: 1549 - DNA, 30 bp, Homo sapiens
gggaccccaagacagcaaacccagcccagt

SEQ ID NO: 1550 - DNA, 22 bp, Homo sapiens
cccaagacagcaaacccagccc

SEQ ID NO: 1551 - DNA, 27 bp, Homo sapiens
ggagttccagccccgagccgagagacg

SEQ ID NO: 1552 - DNA, 22 bp, Homo sapiens
tccagccccgagccgagagacg

SEQ ID NO: 1553 - DNA, 32 bp, Homo sapiens
aagtgtaggcgcctccgaccaagcagccaagg

SEQ ID NO: 1554 - DNA, 22 bp, Homo sapiens
cgcctccgaccaagcagccaag

SEQ ID NO: 1555 - DNA, 30 bp, Homo sapiens
gcccggcatggcaggcacagagggcacggt

SEQ ID NO: 1556 - DNA, 22 bp, Homo sapiens
tggcaggcacagagggcacggt

SEQ ID NO: 1557 - DNA, 36 bp, Homo sapiens
gcaccgccgctgctgccgccgccgccgccaggaccg

SEQ ID NO: 1558 - DNA, 20 bp, Homo sapiens
tgccgccgccgccgccagga

SEQ ID NO: 1559 - DNA, 22 bp, Homo sapiens
caccgccgctgctgccgccgcc

SEQ ID NO: 1560 - DNA, 33 bp, Homo sapiens
ccgcagtctgccgtctccactttgtccgccggt

SEQ ID NO: 1561 - DNA, 22 bp, Homo sapiens
gccgtctccactttgtccgccg

SEQ ID NO: 1562 - DNA, 24 bp, Homo sapiens
cggcctcccgttcctccgcagtct

SEQ ID NO: 1563 - DNA, 22 bp, Homo sapiens
gcctcccgttcctccgcagtct

SEQ ID NO: 1564 - DNA, 33 bp, Homo sapiens
gcaggaggatgcggttcgcttgctgcctctcgg

SEQ ID NO: 1565 - DNA, 21 bp, Homo sapiens
ggttcgcttgctgcctctcgg

SEQ ID NO: 1566 - DNA, 32 bp, Homo sapiens
gcagattctgcagggcgaagagcgacgagttg

SEQ ID NO: 1567 - DNA, 22 bp, Homo sapiens
tgcagggcgaagagcgacgagt

SEQ ID NO: 1568 - DNA, 34 bp, Homo sapiens
ccacagggcagaatgggcaggctcactcgcaggc

SEQ ID NO: 1569 - DNA, 22 bp, Homo sapiens
atgggcaggctcactcgcaggc

SEQ ID NO: 1570 - DNA, 26 bp, Homo sapiens
gccacggcggagcagggcagcggatc

SEQ ID NO: 1571 - DNA, 22 bp, Homo sapiens
ccacggcggagcagggcagcgg

SEQ ID NO: 1572 - DNA, 33 bp, Homo sapiens
ggccgaggcgccgctggagttgcttagggagtt

SEQ ID NO: 1573 - DNA, 22 bp, Homo sapiens
gcgccgctggagttgcttaggg

SEQ ID NO: 1574 - DNA, 23 bp, Homo sapiens
gggagttgggtggaggcgatggg

SEQ ID NO: 1575 - DNA, 35 bp, Homo sapiens
ggctccggacgccgtgccaaccccctctctgctgc

SEQ ID NO: 1576 - DNA, 22 bp, Homo sapiens
cgccgtgccaaccccctctctg

SEQ ID NO: 1577 - DNA, 34 bp, Homo sapiens
cctcataaattatccgccgtgacaagcccgattc

SEQ ID NO: 1578 - DNA, 22 bp, Homo sapiens
tccgccgtgacaagcccgattc

SEQ ID NO: 1579 - DNA, 52 bp, Homo sapiens
gtcaccctccctcaaagttccagccccgagagccgcctcccgtttccagcct

SEQ ID NO: 1580 - DNA, 22 bp, Homo sapiens
agccgcctcccgtttccagcct

SEQ ID NO: 1581 - DNA, 22 bp, Homo sapiens
gttccagccccgagagccgcct

SEQ ID NO: 1582 - DNA, 24 bp, Homo sapiens
ccctccctcaaagttccagccccg

SEQ ID NO: 1583 - DNA, 25 bp, Homo sapiens
tgcccaccgcacagaaacccaggaa

SEQ ID NO: 1584 - DNA, 22 bp, Homo sapiens
gcccaccgcacagaaacccagg

SEQ ID NO: 1585 - DNA, 36 bp, Homo sapiens
tcctataaaggcacgcagggacacaccgcttggagt

SEQ ID NO: 1586 - DNA, 22 bp, Homo sapiens
ggcacgcagggacacaccgctt

SEQ ID NO: 1587 - DNA, 36 bp, Homo sapiens
cactcccctctccccaaagaccgtgccccagaaggt

SEQ ID NO: 1588 - DNA, 22 bp, Homo sapiens
tccccaaagaccgtgccccaga

SEQ ID NO: 1589 - DNA, 29 bp, Homo sapiens
cggtccgcggcgcgtagtaggaggcaggg

SEQ ID NO: 1590 - DNA, 23 bp, Homo sapiens
gcggcgcgtagtaggaggcaggg

SEQ ID NO: 1591 - DNA, 26 bp, Homo sapiens
gggtacagcgcggcagcagggtaggc

SEQ ID NO: 1592 - DNA, 22 bp, Homo sapiens
gggtacagcgcggcagcagggt

SEQ ID NO: 1593 - DNA, 34 bp, Homo sapiens
acaaacagagcgtgtgggcgatctcgatgcggcg

SEQ ID NO: 1594 - DNA, 22 bp, Homo sapiens
tgtgggcgatctcgatgcggcg

SEQ ID NO: 1595 - DNA, 39 bp, Homo sapiens
agaagattatatggaggagggaacgggtgtggaggtgct

SEQ ID NO: 1596 - DNA, 22 bp, Homo sapiens
tggaggagggaacgggtgtgga

SEQ ID NO: 1597 - DNA, 27 bp, Homo sapiens
gcgagctctcgcccaccgccccaaagt

SEQ ID NO: 1598 - DNA, 22 bp, Homo sapiens
gctctcgcccaccgccccaaag

SEQ ID NO: 1599 - DNA, 33 bp, Homo sapiens
cctctgggcgggctcaaggctggaaggcgctgc

SEQ ID NO: 1600 - DNA, 22 bp, Homo sapiens
gcgggctcaaggctggaaggcg

SEQ ID NO: 1601 - DNA, 35 bp, Homo sapiens
tcgtaacacaaggcgaggcaggcttgtgggaaccg

SEQ ID NO: 1602 - DNA, 22 bp, Homo sapiens
cgaggcaggcttgtgggaaccg

SEQ ID NO: 1603 - DNA, 23 bp, Homo sapiens
cgtaacacaaggcgaggcaggct

SEQ ID NO: 1604 - DNA, 33 bp, Homo sapiens
ggccatttggataacgccccgagaaggagttta

SEQ ID NO: 1605 - DNA, 25 bp, Homo sapiens
ccatttggataacgccccgagaagg

SEQ ID NO: 1606 - DNA, 30 bp, Homo sapiens
ggcactaccccacctcaactgctgcccctt

SEQ ID NO: 1607 - DNA, 22 bp, Homo sapiens
ccccacctcaactgctgcccct

SEQ ID NO: 1608 - DNA, 56 bp, Homo sapiens
ttccctccctttccatccatcttgttcccaccccccgtcatccccccaacccaatg

SEQ ID NO: 1609 - DNA, 22 bp, Homo sapiens
cccgtcatccccccaacccaat

SEQ ID NO: 1610 - DNA, 33 bp, Homo sapiens
cggctcccttcccccgtttcgcactcctccagc

SEQ ID NO: 1611 - DNA, 22 bp, Homo sapiens
ggctcccttcccccgtttcgca

SEQ ID NO: 1612 - DNA, 39 bp, Homo sapiens
gcctttccctcggcgtcctccctccctttccagcacctt

SEQ ID NO: 1613 - DNA, 22 bp, Homo sapiens
ttccctcggcgtcctccctccc

SEQ ID NO: 1614 - DNA, 30 bp, Homo sapiens
ctcccccacccgagagccttccttcccggg

SEQ ID NO: 1615 - DNA, 22 bp, Homo sapiens
tcccccacccgagagccttcct

SEQ ID NO: 1616 - DNA, 31 bp, Homo sapiens
ggtctggcggcctcgtttgcggtcagttcct

SEQ ID NO: 1617 - DNA, 22 bp, Homo sapiens
gcctcgtttgcggtcagttcct

SEQ ID NO: 1618 - DNA, 33 bp, Homo sapiens
cagggtctggtagcgggtgtaggtctggcggcc

SEQ ID NO: 1619 - DNA, 22 bp, Homo sapiens
tagcgggtgtaggtctggcggc

SEQ ID NO: 1620 - DNA, 32 bp, Homo sapiens
ttgatctgtctttccgtgaggcagagcgtgtg

SEQ ID NO: 1621 - DNA, 22 bp, Homo sapiens
tttccgtgaggcagagcgtgtg

SEQ ID NO: 1622 - DNA, 35 bp, Homo sapiens
ccctcactcttcctcttcctcctctgcttcagccc

SEQ ID NO: 1623 - DNA, 24 bp, Homo sapiens
cctcttcctcctctgcttcagccc

SEQ ID NO: 1624 - DNA, 22 bp, Homo sapiens
ttcctcttcctcctctgcttca

SEQ ID NO: 1625 - DNA, 28 bp, Homo sapiens
tcgccgcttacgagtcagatagggatta

SEQ ID NO: 1626 - DNA, 22 bp, Homo sapiens
cgccgcttacgagtcagatagg

SEQ ID NO: 1627 - DNA, 27 bp, Homo sapiens
aggtctgtcggcctcgcctgcgtccgg

SEQ ID NO: 1628 - DNA, 22 bp, Homo sapiens
tctgtcggcctcgcctgcgtcc

SEQ ID NO: 1629 - DNA, 35 bp, Homo sapiens
cctgtctctctgtcagtcccagggcgtgcgatacc

SEQ ID NO: 1630 - DNA, 22 bp, Homo sapiens
ctgtcagtcccagggcgtgcga

SEQ ID NO: 1631 - DNA, 38 bp, Homo sapiens
ccttattcattttcttcattttcatccgccggttctga

SEQ ID NO: 1632 - DNA, 22 bp, Homo sapiens
tttcttcattttcatccgccgg

SEQ ID NO: 1633 - DNA, 37 bp, Homo sapiens
cgctttttccgggaagagcgagcgtgcagccagttgg

SEQ ID NO: 1634 - DNA, 22 bp, Homo sapiens
cgggaagagcgagcgtgcagcc

SEQ ID NO: 1635 - DNA, 35 bp, Homo sapiens
ggccacttcgtgcctacggtccctggtgaggtaca

SEQ ID NO: 1636 - DNA, 22 bp, Homo sapiens
gccacttcgtgcctacggtccc

SEQ ID NO: 1637 - DNA, 44 bp, Homo sapiens
ccgtgtcaggtagcggttgtagtgaaattccttctccagctcca

SEQ ID NO: 1638 - DNA, 25 bp, Homo sapiens
gcggttgtagtgaaattccttctcc

SEQ ID NO: 1639 - DNA, 22 bp, Homo sapiens
cgtgtcaggtagcggttgtagt

SEQ ID NO: 1640 - DNA, 30 bp, Homo sapiens
cgcgtgtaggcggtccgagagcgcttgggc

SEQ ID NO: 1641 - DNA, 22 bp, Homo sapiens
gcgtgtaggcggtccgagagcg

SEQ ID NO: 1642 - DNA, 20 bp, Homo sapiens
cggtccgagagcgcttgggc

SEQ ID NO: 1643 - DNA, 34 bp, Homo sapiens
gcgatctccaccctccggcgccgtgtcaggtagc

SEQ ID NO: 1644 - DNA, 22 bp, Homo sapiens
tccaccctccggcgccgtgtca

SEQ ID NO: 1645 - DNA, 41 bp, Homo sapiens
cagatcttgatctggcgctcggagaggcagagcgcgtgggc

SEQ ID NO: 1646 - DNA, 22 bp, Homo sapiens
cggagaggcagagcgcgtgggc

SEQ ID NO: 1647 - DNA, 41 bp, Homo sapiens
tcgagccccagagcgagcggcaggcgacaaatctcccctcc

SEQ ID NO: 1648 - DNA, 22 bp, Homo sapiens
ccccagagcgagcggcaggcga

SEQ ID NO: 1649 - DNA, 27 bp, Homo sapiens
gcgcccgcttggacgccgccgaccccg

SEQ ID NO: 1650 - DNA, 22 bp, Homo sapiens
cgcccgcttggacgccgccgac

SEQ ID NO: 1651 - DNA, 27 bp, Homo sapiens
gcagggtccgtggtgctggctgggcgc

SEQ ID NO: 1652 - DNA, 22 bp, Homo sapiens
gggtccgtggtgctggctgggc

SEQ ID NO: 1653 - DNA, 38 bp, Homo sapiens
gaatatctgtttggtgagggtggagttggtgccgggac

SEQ ID NO: 1654 - DNA, 22 bp, Homo sapiens
tgagggtggagttggtgccggg

SEQ ID NO: 1655 - DNA, 57 bp, Homo sapiens
cacagtctctctcttcctccccatcccctaatcctcgttcgccctttcccatcacag

SEQ ID NO: 1656 - DNA, 22 bp, Homo sapiens
cctcgttcgccctttcccatca

SEQ ID NO: 1657 - DNA, 35 bp, Homo sapiens
ggattcctttccgatgggttggcaggcagatggaa

SEQ ID NO: 1658 - DNA, 22 bp, Homo sapiens
ttccgatgggttggcaggcaga

SEQ ID NO: 1659 - DNA, 37 bp, Homo sapiens
gcccatcttcggctcgcttttggctcctgggtctctg

SEQ ID NO: 1660 - DNA, 22 bp, Homo sapiens
cggctcgcttttggctcctggg

SEQ ID NO: 1661 - DNA, 46 bp, Homo sapiens
cggagaaggagacgtggcggattggctgggtttcttggcggatttc

SEQ ID NO: 1662 - DNA, 22 bp, Homo sapiens
gagacgtggcggattggctggg

SEQ ID NO: 1663 - DNA, 22 bp, Homo sapiens
tggctgggtttcttggcggatt

SEQ ID NO: 1664 - DNA, 36 bp, Homo sapiens
gcagctgcgtgttggtgtaagccgtgcgcagcctgc

SEQ ID NO: 1665 - DNA, 22 bp, Homo sapiens
gcgtgttggtgtaagccgtgcg

SEQ ID NO: 1666 - DNA, 22 bp, Homo sapiens
ttggtgtaagccgtgcgcagcc

SEQ ID NO: 1667 - DNA, 27 bp, Homo sapiens
ccggcggctctcggtgctgcgtctgcc

SEQ ID NO: 1668 - DNA, 22 bp, Homo sapiens
cggcggctctcggtgctgcgtc

SEQ ID NO: 1669 - DNA, 29 bp, Homo sapiens
cgggttcctcggcagggtcgcagatgtcc

SEQ ID NO: 1670 - DNA, 22 bp, Homo sapiens
ctcggcagggtcgcagatgtcc

SEQ ID NO: 1671 - DNA, 38 bp, Homo sapiens
tcgagccccagagcgagcggcaggcgacaaatctcccc

SEQ ID NO: 1672 - DNA, 22 bp, Homo sapiens
ccccagagcgagcggcaggcga

SEQ ID NO: 1673 - DNA, 27 bp, Homo sapiens
gcgcccgcttggacgccgccgaccccg

SEQ ID NO: 1674 - DNA, 22 bp, Homo sapiens
cgcttggacgccgccgaccccg

SEQ ID NO: 1675 - DNA, 32 bp, Homo sapiens
gggttcgcagggtccgtggtgctggctgggcg

SEQ ID NO: 1676 - DNA, 22 bp, Homo sapiens
ggtccgtggtgctggctgggcg

SEQ ID NO: 1677 - DNA, 31 bp, Homo sapiens
tgcaggcggcaggagcataccccgagggcgc

SEQ ID NO: 1678 - DNA, 22 bp, Homo sapiens
gcaggcggcaggagcatacccc

SEQ ID NO: 1679 - DNA, 22 bp, Homo sapiens
caggagcataccccgagggcgc

SEQ ID NO: 1680 - DNA, 25 bp, Homo sapiens
ccgtagccatcggacaagcccccta

SEQ ID NO: 1681 - DNA, 22 bp, Homo sapiens
cgtagccatcggacaagccccc

SEQ ID NO: 1682 - DNA, 38 bp, Homo sapiens
gcctgggttgggagagcctgggatagggctggactggg

SEQ ID NO: 1683 - DNA, 22 bp, Homo sapiens
gcctgggttgggagagcctggg

SEQ ID NO: 1684 - DNA, 19 bp, Homo sapiens
gggatagggctggactggg

SEQ ID NO: 1685 - DNA, 24 bp, Homo sapiens
ggcctcccagcccctcagtgcgat

SEQ ID NO: 1686 - DNA, 22 bp, Homo sapiens
gcctcccagcccctcagtgcga

SEQ ID NO: 1687 - DNA, 45 bp, Homo sapiens
cccaaaccgactgatcccagctccccccgcaacaaaatcctacgc

SEQ ID NO: 1688 - DNA, 22 bp, Homo sapiens
gctccccccgcaacaaaatcct

SEQ ID NO: 1689 - DNA, 22 bp, Homo sapiens
tcccagctccccccgcaacaaa

SEQ ID NO: 1690 - DNA, 38 bp, Homo sapiens
cggtcttctctttccctccgctctccgcctccgctacg

SEQ ID NO: 1691 - DNA, 22 bp, Homo sapiens
ttccctccgctctccgcctccg

SEQ ID NO: 1692 - DNA, 30 bp, Homo sapiens
gcgctcctcacccgcctcttcacccgtttg

SEQ ID NO: 1693 - DNA, 22 bp, Homo sapiens
tcctcacccgcctcttcacccg

SEQ ID NO: 1694 - DNA, 35 bp, Homo sapiens
cggccccatcctcttcccccgtagccccaagtctc

SEQ ID NO: 1695 - DNA, 21 bp, Homo sapiens
ggccccatcctcttcccccgt

SEQ ID NO: 1696 - DNA, 24 bp, Homo sapiens
ggaccgcttgccgtccgtctctgg

SEQ ID NO: 1697 - DNA, 22 bp, Homo sapiens
accgcttgccgtccgtctctgg

SEQ ID NO: 1698 - DNA, 35 bp, Homo sapiens
gtgctccagcacctgcccccgacccgaaatataga

SEQ ID NO: 1699 - DNA, 22 bp, Homo sapiens
cacctgcccccgacccgaaata

SEQ ID NO: 1700 - DNA, 40 bp, Homo sapiens
accctgggtcggtagggatgcggaatgccaaggaaaagcg

SEQ ID NO: 1701 - DNA, 22 bp, Homo sapiens
tcggtagggatgcggaatgcca

SEQ ID NO: 1702 - DNA, 31 bp, Homo sapiens
ggcaaagccccccaccaacccccagcaaagt

SEQ ID NO: 1703 - DNA, 22 bp, Homo sapiens
agccccccaccaacccccagca

SEQ ID NO: 1704 - DNA, 42 bp, Homo sapiens
gctttcaaaaagccctgcccaaatcatcccgcccagaacctt

SEQ ID NO: 1705 - DNA, 22 bp, Homo sapiens
gccctgcccaaatcatcccgcc

SEQ ID NO: 1706 - DNA, 25 bp, Homo sapiens
gggcagggtcggtggtggaggaggg

SEQ ID NO: 1707 - DNA, 22 bp, Homo sapiens
gggcagggtcggtggtggagga

SEQ ID NO: 1708 - DNA, 36 bp, Homo sapiens
tgggctgtgatttggcgaaagcaggcggcgagggcg

SEQ ID NO: 1709 - DNA, 22 bp, Homo sapiens
gcgaaagcaggcggcgagggcg

SEQ ID NO: 1710 - DNA, 30 bp, Homo sapiens
cccacctttgggcttcttggcaggcactcc

SEQ ID NO: 1711 - DNA, 22 bp, Homo sapiens
tgggcttcttggcaggcactcc

SEQ ID NO: 1712 - DNA, 38 bp, Homo sapiens
agcctagtccatcaacccatacccacccaaaggccatg

SEQ ID NO: 1713 - DNA, 22 bp, Homo sapiens
acccatacccacccaaaggcca

SEQ ID NO: 1714 - DNA, 32 bp, Homo sapiens
gaaggatccttgcggctgatttatggcgagtc

SEQ ID NO: 1715 - DNA, 22 bp, Homo sapiens
ccttgcggctgatttatggcga

SEQ ID NO: 1716 - DNA, 41 bp, Homo sapiens
tccagactggagcccagagcccctttcacttgagccagcct

SEQ ID NO: 1717 - DNA, 22 bp, Homo sapiens
ggagcccagagcccctttcact

SEQ ID NO: 1718 - DNA, 38 bp, Homo sapiens
ttaaatattcacctcccgctcaactgcccatactaatg

SEQ ID NO: 1719 - DNA, 22 bp, Homo sapiens
tcacctcccgctcaactgccca

SEQ ID NO: 1720 - DNA, 41 bp, Homo sapiens
gcctggcactttgctcatccccccatcctttgcttccacca

SEQ ID NO: 1721 - DNA, 22 bp, Homo sapiens
ccccccatcctttgcttccacc

SEQ ID NO: 1722 - DNA, 49 bp, Homo sapiens
cgggctggcctctccgttccgctgctgctgcagaccccgaggcaggcgc

SEQ ID NO: 1723 - DNA, 22 bp, Homo sapiens
gcctctccgttccgctgctgct

SEQ ID NO: 1724 - DNA, 20 bp, Homo sapiens
gcagaccccgaggcaggcgc

SEQ ID NO: 1725 - DNA, 36 bp, Homo sapiens
tgtctactccttttcctactgcccgaccaagccagg

SEQ ID NO: 1726 - DNA, 22 bp, Homo sapiens
cctactgcccgaccaagccagg

SEQ ID NO: 1727 - DNA, 39 bp, Homo sapiens
cattttgaggcgtcccgcactcccacccaacattacact

SEQ ID NO: 1728 - DNA, 22 bp, Homo sapiens
cgtcccgcactcccacccaaca

SEQ ID NO: 1729 - DNA, 23 bp, Homo sapiens
gccgctcatcgccgccgctgccg

SEQ ID NO: 1730 - DNA, 22 bp, Homo sapiens
ccgctcatcgccgccgctgccg

SEQ ID NO: 1731 - DNA, 38 bp, Homo sapiens
gcccgttccccccgtcgccgcctgccgccttctcctgc

SEQ ID NO: 1732 - DNA, 22 bp, Homo sapiens
cgccgcctgccgccttctcctg

SEQ ID NO: 1733 - DNA, 37 bp, Homo sapiens
ggtcaagttgctgctgctgcggctgcgaatgctgctt

SEQ ID NO: 1734 - DNA, 22 bp, Homo sapiens
ttgctgctgctgcggctgcgaa

SEQ ID NO: 1735 - DNA, 28 bp, Homo sapiens
taatgttggtggtgaaggagcaagtggg

SEQ ID NO: 1736 - DNA, 22 bp, Homo sapiens
tggtggtgaaggagcaagtggg

SEQ ID NO: 1737 - DNA, 31 bp, Homo sapiens
tcctgcacttcgggactggacacggagacct

SEQ ID NO: 1738 - DNA, 22 bp, Homo sapiens
tgcacttcgggactggacacgg

SEQ ID NO: 1739 - DNA, 32 bp, Homo sapiens
aaacgtgaggttggcggtcagttctcggatcc

SEQ ID NO: 1740 - DNA, 23 bp, Homo sapiens
aggttggcggtcagttctcggat

SEQ ID NO: 1741 - DNA, 34 bp, Homo sapiens
ggccctggaacgcggtgccccctctccaatcctg

SEQ ID NO: 1742 - DNA, 22 bp, Homo sapiens
cgcggtgccccctctccaatcc

SEQ ID NO: 1743 - DNA, 25 bp, Homo sapiens
tggccgcgccacgagggttgagctg

SEQ ID NO: 1744 - DNA, 22 bp, Homo sapiens
ccgcgccacgagggttgagctg

SEQ ID NO: 1745 - DNA, 36 bp, Homo sapiens
gccaccaccgttcgacgcagccacccgcactttctg

SEQ ID NO: 1746 - DNA, 22 bp, Homo sapiens
cgacgcagccacccgcactttc

SEQ ID NO: 1747 - DNA, 26 bp, Homo sapiens
ggccccaaatacaagcaagcccccat

SEQ ID NO: 1748 - DNA, 22 bp, Homo sapiens
gccccaaatacaagcaagcccc

SEQ ID NO: 1749 - DNA, 27 bp, Homo sapiens
gggtgggctgggatggtggcaagggca

SEQ ID NO: 1750 - DNA, 22 bp, Homo sapiens
gggctgggatggtggcaagggc

SEQ ID NO: 1751 - DNA, 44 bp, Homo sapiens
tggaggctccacacgcccccacctactcgcacccccttccagag

SEQ ID NO: 1752 - DNA, 22 bp, Homo sapiens
cgcccccacctactcgcacccc

SEQ ID NO: 1753 - DNA, 41 bp, Homo sapiens
attaatgtagttccagtccccagcaccccattcccctcagg

SEQ ID NO: 1754 - DNA, 22 bp, Homo sapiens
ccccagcaccccattcccctca

SEQ ID NO: 1755 - DNA, 29 bp, Homo sapiens
tgcgcccacagccgagcagccagccacat

SEQ ID NO: 1756 - DNA, 22 bp, Homo sapiens
cgcccacagccgagcagccagc

SEQ ID NO: 1757 - DNA, 34 bp, Homo sapiens
tcctcaaacacacccacataccccaggcttgcgg

SEQ ID NO: 1758 - DNA, 22 bp, Homo sapiens
cccacataccccaggcttgcgg

SEQ ID NO: 1759 - DNA, 29 bp, Homo sapiens
gctttttccgggtggagcgagcgtggatc

SEQ ID NO: 1760 - DNA, 22 bp, Homo sapiens
ccgggtggagcgagcgtggatc

SEQ ID NO: 1761 - DNA, 32 bp, Homo sapiens
ggttgagaatcctggccacctcgtagcgccgg

SEQ ID NO: 1762 - DNA, 22 bp, Homo sapiens
aatcctggccacctcgtagcgc

SEQ ID NO: 1763 - DNA, 30 bp, Homo sapiens
agctcaagcgtctggtatttggtgtaggga

SEQ ID NO: 1764 - DNA, 24 bp, Homo sapiens
agcgtctggtatttggtgtaggga

SEQ ID NO: 1765 - DNA, 40 bp, Homo sapiens
gggcttcctttttcgtttccccgtccttcacctcctgccg

SEQ ID NO: 1766 - DNA, 22 bp, Homo sapiens
ccccgtccttcacctcctgccg

SEQ ID NO: 1767 - DNA, 35 bp, Homo sapiens
cctgtctctcggtgagggctagggcgtgggaaacc

SEQ ID NO: 1768 - DNA, 22 bp, Homo sapiens
cggtgagggctagggcgtggga

SEQ ID NO: 1769 - DNA, 29 bp, Homo sapiens
gggcacgcagggcagggcacggcggaggt

SEQ ID NO: 1770 - DNA, 22 bp, Homo sapiens
cagggcagggcacggcggaggt

SEQ ID NO: 1771 - DNA, 31 bp, Homo sapiens
gggcttggccccctcctcgtctgtgcccatg

SEQ ID NO: 1772 - DNA, 23 bp, Homo sapiens
gccccctcctcgtctgtgcccat

SEQ ID NO: 1773 - DNA, 25 bp, Homo sapiens
gcgccgagccacccgccgcctgcac

SEQ ID NO: 1774 - DNA, 22 bp, Homo sapiens
cgccgagccacccgccgcctgc

SEQ ID NO: 1775 - DNA, 33 bp, Homo sapiens
aggggccagaggcaccgtagagcgaggcacccg

SEQ ID NO: 1776 - DNA, 22 bp, Homo sapiens
gcaccgtagagcgaggcacccg

SEQ ID NO: 1777 - DNA, 28 bp, Homo sapiens
agcaccagggctggaggaatcggctggc

SEQ ID NO: 1778 - DNA, 22 bp, Homo sapiens
agggctggaggaatcggctggc

SEQ ID NO: 1779 - DNA, 35 bp, Homo sapiens
agtgtgagggttaaagggaaggcggctggcggtgc

SEQ ID NO: 1780 - DNA, 22 bp, Homo sapiens
aagggaaggcggctggcggtgc

SEQ ID NO: 1781 - DNA, 27 bp, Homo sapiens
ggcaacgccaatcgccttcccatcccc

SEQ ID NO: 1782 - DNA, 22 bp, Homo sapiens
cgccaatcgccttcccatcccc

SEQ ID NO: 1783 - DNA, 22 bp, Homo sapiens
gggtcctctcgggcttctcggg

SEQ ID NO: 1784 - DNA, 24 bp, Homo sapiens
gggccgccgagagggaaggagagg

SEQ ID NO: 1785 - DNA, 22 bp, Homo sapiens
gccgccgagagggaaggagagg

SEQ ID NO: 1786 - DNA, 29 bp, Homo sapiens
gccagaggcaccgtagagcgaggcacccg

SEQ ID NO: 1787 - DNA, 22 bp, Homo sapiens
gcaccgtagagcgaggcacccg

SEQ ID NO: 1788 - DNA, 28 bp, Homo sapiens
cagggctggaggaatcggctggcccaca

SEQ ID NO: 1789 - DNA, 22 bp, Homo sapiens
agggctggaggaatcggctggc

SEQ ID NO: 1790 - DNA, 31 bp, Homo sapiens
tgagggttaaagggaaggcggctggcggtgc

SEQ ID NO: 1791 - DNA, 22 bp, Homo sapiens
aagggaaggcggctggcggtgc

SEQ ID NO: 1792 - DNA, 31 bp, Homo sapiens
acacatctgtgttttccctgccccccagagc

SEQ ID NO: 1793 - DNA, 22 bp, Homo sapiens
tctgtgttttccctgcccccca

SEQ ID NO: 1794 - DNA, 32 bp, Homo sapiens
catcttctgaattttccgacttgaccgaggcg

SEQ ID NO: 1795 - DNA, 22 bp, Homo sapiens
attttccgacttgaccgaggcg

SEQ ID NO: 1796 - DNA, 31 bp, Homo sapiens
ccggttcctgcatccacgccgctccatcttc

SEQ ID NO: 1797 - DNA, 22 bp, Homo sapiens
gcatccacgccgctccatcttc

SEQ ID NO: 1798 - DNA, 43 bp, Homo sapiens
gggtgcaggtggtagggctcgtatgtcttggcggcggcgaata

SEQ ID NO: 1799 - DNA, 22 bp, Homo sapiens
tcgtatgtcttggcggcggcga

SEQ ID NO: 1800 - DNA, 36 bp, Homo sapiens
cagggcgaggagctgggatgtggtaaagggcgtgcg

SEQ ID NO: 1801 - DNA, 22 bp, Homo sapiens
gggatgtggtaaagggcgtgcg

SEQ ID NO: 1802 - DNA, 29 bp, Homo sapiens
ccaacaggcgggatgggaagcacaggtct

SEQ ID NO: 1803 - DNA, 22 bp, Homo sapiens
gcgggatgggaagcacaggtct

SEQ ID NO: 1804 - DNA, 25 bp, Homo sapiens
ggcttggtgcctccgcctacagaac

SEQ ID NO: 1805 - DNA, 22 bp, Homo sapiens
gcttggtgcctccgcctacaga

SEQ ID NO: 1806 - DNA, 34 bp, Homo sapiens
agcgacaggcttcttggtggctggcgtggagagg

SEQ ID NO: 1807 - DNA, 22 bp, Homo sapiens
ggcttcttggtggctggcgtgg

SEQ ID NO: 1808 - DNA, 36 bp, Homo sapiens
tctcacgtttcttttgcttcattcggcggttctgga

SEQ ID NO: 1809 - DNA, 22 bp, Homo sapiens
tgcttcattcggcggttctgga

SEQ ID NO: 1810 - DNA, 36 bp, Homo sapiens
gaggattcctcggccttctcgtcgtttcctggcggg

SEQ ID NO: 1811 - DNA, 22 bp, Homo sapiens
ccttctcgtcgtttcctggcgg

SEQ ID NO: 1812 - DNA, 24 bp, Homo sapiens
cagcgatctccacctgcgggcgcg

SEQ ID NO: 1813 - DNA, 21 bp, Homo sapiens
cgatctccacctgcgggcgcg

SEQ ID NO: 1814 - DNA, 17 bp, Homo sapiens
atctccacctgcgggcg

SEQ ID NO: 1815 - DNA, 32 bp, Homo sapiens
gctaatctctaggcgccgctctcgagtaaggt

SEQ ID NO: 1816 - DNA, 22 bp, Homo sapiens
aatctctaggcgccgctctcga

SEQ ID NO: 1817 - DNA, 28 bp, Homo sapiens
gtgaggtggacgctgcggctaatctcta

SEQ ID NO: 1818 - DNA, 24 bp, Homo sapiens
tgaggtggacgctgcggctaatct

SEQ ID NO: 1819 - DNA, 35 bp, Homo sapiens
ttctttacgtggccagcagcatccccttcccttct

SEQ ID NO: 1820 - DNA, 22 bp, Homo sapiens
tggccagcagcatccccttccc

SEQ ID NO: 1821 - DNA, 38 bp, Homo sapiens
cctcacatgctctctccccaatgcctccgtttctccag

SEQ ID NO: 1822 - DNA, 22 bp, Homo sapiens
tgctctctccccaatgcctccg

SEQ ID NO: 1823 - DNA, 23 bp, Homo sapiens
ggcctccgccaatcgctcgtctg

SEQ ID NO: 1824 - DNA, 22 bp, Homo sapiens
gcctccgccaatcgctcgtctg

SEQ ID NO: 1825 - DNA, 24 bp, Homo sapiens
gggcgtcaggagggaggatcggaa

SEQ ID NO: 1826 - DNA, 22 bp, Homo sapiens
gggcgtcaggagggaggatcgg

SEQ ID NO: 1827 - DNA, 23 bp, Homo sapiens
ctctccgtcaggcacagggcgtg

SEQ ID NO: 1828 - DNA, 22 bp, Homo sapiens
ctctccgtcaggcacagggcgt

SEQ ID NO: 1829 - DNA, 25 bp, Homo sapiens
cacagggcgtgcgcgatctcgatgc

SEQ ID NO: 1830 - DNA, 22 bp, Homo sapiens
agggcgtgcgcgatctcgatgc

SEQ ID NO: 1831 - DNA, 30 bp, Homo sapiens
gaaccatattttcctctgcctctccgtcag

SEQ ID NO: 1832 - DNA, 22 bp, Homo sapiens
attttcctctgcctctccgtca

SEQ ID NO: 1833 - DNA, 26 bp, Homo sapiens
gcgttggcgatctcgatgcggcggcg

SEQ ID NO: 1834 - DNA, 22 bp, Homo sapiens
cgttggcgatctcgatgcggcg

SEQ ID NO: 1835 - DNA, 36 bp, Homo sapiens
ggaaccatatcttgctctgtcgctcggtcaggcaaa

SEQ ID NO: 1836 - DNA, 22 bp, Homo sapiens
atcttgctctgtcgctcggtca

SEQ ID NO: 1837 - DNA, 38 bp, Homo sapiens
tttctcgtcttccctcattctgtgccgctgccgagcct

SEQ ID NO: 1838 - DNA, 22 bp, Homo sapiens
ccctcattctgtgccgctgccg

SEQ ID NO: 1839 - DNA, 36 bp, Homo sapiens
tcccagctggaccaggcaggtagaggcagcgggatg

SEQ ID NO: 1840 - DNA, 22 bp, Homo sapiens
ccaggcaggtagaggcagcggg

SEQ ID NO: 1841 - DNA, 40 bp, Homo sapiens
aacctggtaatgtcctctgcccgttgctgctccggcggcg

SEQ ID NO: 1842 - DNA, 22 bp, Homo sapiens
tcctctgcccgttgctgctccg

SEQ ID NO: 1843 - DNA, 25 bp, Homo sapiens
gcccccgcgagcgctgctgtcactc

SEQ ID NO: 1844 - DNA, 22 bp, Homo sapiens
gcccccgcgagcgctgctgtca

SEQ ID NO: 1845 - DNA, 25 bp, Homo sapiens
ctcagggtagctagggcgcggaggc

SEQ ID NO: 1846 - DNA, 22 bp, Homo sapiens
agggtagctagggcgcggaggc

SEQ ID NO: 1847 - DNA, 22 bp, Homo sapiens
cctcgcgaattgccgggcccct

SEQ ID NO: 1848 - DNA, 23 bp, Homo sapiens
cggcgtggcgctctgggagtggt

SEQ ID NO: 1849 - DNA, 22 bp, Homo sapiens
cggcgtggcgctctgggagtgg

SEQ ID NO: 1850 - DNA, 24 bp, Homo sapiens
cgttgctgctccggcggcgtggcg

SEQ ID NO: 1851 - DNA, 22 bp, Homo sapiens
ttgctgctccggcggcgtggcg

SEQ ID NO: 1852 - DNA, 24 bp, Homo sapiens
gggccagagggtcgggaaggaaga

SEQ ID NO: 1853 - DNA, 22 bp, Homo sapiens
gccagagggtcgggaaggaaga

SEQ ID NO: 1854 - DNA, 23 bp, Homo sapiens
cctgggactggctgggcgagact

SEQ ID NO: 1855 - DNA, 22 bp, Homo sapiens
cctgggactggctgggcgagac

SEQ ID NO: 1856 - DNA, 27 bp, Homo sapiens
ggagagtctcgcccagccagtcccagg

SEQ ID NO: 1857 - DNA, 22 bp, Homo sapiens
gtctcgcccagccagtcccagg

SEQ ID NO: 1858 - DNA, 38 bp, Homo sapiens
caaagcatggaactggcggtagcggcggtagatgaggt

SEQ ID NO: 1859 - DNA, 22 bp, Homo sapiens
tggaactggcggtagcggcggt

SEQ ID NO: 1860 - DNA, 30 bp, Homo sapiens
catgtaggcgttgagggcaggtatccgcat

SEQ ID NO: 1861 - DNA, 22 bp, Homo sapiens
aggcgttgagggcaggtatccg

SEQ ID NO: 1862 - DNA, 40 bp, Homo sapiens
cgctacgtcctcatccgacagcgaccgaaccagatccccc

SEQ ID NO: 1863 - DNA, 22 bp, Homo sapiens
tcatccgacagcagccgaacca

SEQ ID NO: 1864 - DNA, 40 bp, Homo sapiens
ccacctgtgcaagcctctgttctaagcgcccggcggaatt

SEQ ID NO: 1865 - DNA, 22 bp, Homo sapiens
gttctaagcgcccggcggaatt

SEQ ID NO: 1866 - DNA, 29 bp, Homo sapiens
ggtcttggctccccatcgttgctcctttt

SEQ ID NO: 1867 - DNA, 22 bp, Homo sapiens
ggctccccatcgttgctccttt

SEQ ID NO: 1868 - DNA, 29 bp, Homo sapiens
gaagcggcttctatgggcgtcgtcttctt

SEQ ID NO: 1869 - DNA, 22 bp, Homo sapiens
gcggcttctatgggcgtcgtct

SEQ ID NO: 1870 - DNA, 25 bp, Homo sapiens
gcctttcgctcctgttgcctcctgg

SEQ ID NO: 1871 - DNA, 22 bp, Homo sapiens
gcctttcgctcctgttgcctcc

SEQ ID NO: 1872 - DNA, 48 bp, Homo sapiens
tagtcattctcaggctcgggctcaggctcgggctcaggctcaggctct

SEQ ID NO: 1873 - DNA, 22 bp, Homo sapiens
ggctcgggctcaggctcgggct

SEQ ID NO: 1874 - DNA, 43 bp, Homo sapiens
ctgagatccccagagccacagccccagccccagccccagccgg

SEQ ID NO: 1875 - DNA, 22 bp, Homo sapiens
ccccagagccacagccccagcc

SEQ ID NO: 1876 - DNA, 22 bp, Homo sapiens
ccccagccccagccccagccgg

SEQ ID NO: 1877 - DNA, 34 bp, Homo sapiens
gcaacgtccccgccaccagccctcgtccaccatc

SEQ ID NO: 1878 - DNA, 22 bp, Homo sapiens
ccccgccaccagccctcgtcca

SEQ ID NO: 1879 - DNA, 63 bp, Homo sapiens
agtcatatcccagagctgctttgtcccatttatccttctccaccccgtaccggccaccaaagc

SEQ ID NO: 1880 - DNA, 22 bp, Homo sapiens
tccaccccgtaccggccaccaa

SEQ ID NO: 1881 - DNA, 39 bp, Homo sapiens
cctcagccatggactcaaatttcgccttcagcccacggg

SEQ ID NO: 1882 - DNA, 22 bp, Homo sapiens
aatttcgccttcagcccacggg

SEQ ID NO: 1883 - DNA, 44 bp, Homo sapiens
ttgggcttccccccgctccccacttcgccagcgcccgctcctcg

SEQ ID NO: 1884 - DNA, 22 bp, Homo sapiens
cttcgccagcgcccgctcctcg

SEQ ID NO: 1885 - DNA, 45 bp, Homo sapiens
gcagcatcctcgcattcagccaacccccccagtccccagaagcac

SEQ ID NO: 1886 - DNA, 22 bp, Homo sapiens
cagccaacccccccagtcccca

SEQ ID NO: 1887 - DNA, 22 bp, Homo sapiens
tcgcattcagccaaccccccca

SEQ ID NO: 1888 - DNA, 29 bp, Homo sapiens
ggcttccccccgctccccacttcgccagc

SEQ ID NO: 1889 - DNA, 22 bp, Homo sapiens
cccccgctccccacttcgccag

SEQ ID NO: 1890 - DNA, 40 bp, Homo sapiens
gccacttctgccgccccgtctccgcatccaaccaccccga

SEQ ID NO: 1891 - DNA, 21 bp, Homo sapiens
gccgccccgtctccgcatcca

SEQ ID NO: 1892 - DNA, 32 bp, Homo sapiens
gcattgttagccatccgcctctccttctccct

SEQ ID NO: 1893 - DNA, 22 bp, Homo sapiens
gccatccgcctctccttctccc

SEQ ID NO: 1894 - DNA, 34 bp, Homo sapiens
gatgggttcctggcagtgtggttggcggctctgc

SEQ ID NO: 1895 - DNA, 22 bp, Homo sapiens
tggcagtgtggttggcggctct

SEQ ID NO: 1896 - DNA, 34 bp, Homo sapiens
gctcctggaaacggcgagcgagagtgaggagagg

SEQ ID NO: 1897 - DNA, 22 bp, Homo sapiens
tggaaacggcgagcgagagtga

SEQ ID NO: 1898 - DNA, 32 bp, Homo sapiens
tgccgcgctgcttgggctgctccgtgatgacc

SEQ ID NO: 1899 - DNA, 22 bp, Homo sapiens
cgctgcttgggctgctccgtga

SEQ ID NO: 1900 - DNA, 36 bp, Homo sapiens
agcgtcttgctggcctcggtgctgctctccccaagg

SEQ ID NO: 1901 - DNA, 22 bp, Homo sapiens
gcctcggtgctgctctccccaa

SEQ ID NO: 1902 - DNA, 40 bp, Homo sapiens
aggcagtcacctccacctcccgcagccctccacaatcccg

SEQ ID NO: 1903 - DNA, 22 bp, Homo sapiens
cccgcagccctccacaatcccg

SEQ ID NO: 1904 - DNA, 22 bp, Homo sapiens
ctccacctcccgcagccctcca

SEQ ID NO: 1905 - DNA, 38 bp, Homo sapiens
tgctgaacaccactgatatgtcctctttgtgcaccttg

SEQ ID NO: 1906 - DNA, 22 bp, Homo sapiens
tcgtagggcggcgtcttgaaca

SEQ ID NO: 1907 - DNA, 30 bp, Homo sapiens
ggcaggtacgtgaaaggcaatggctcgctg

SEQ ID NO: 1908 - DNA, 22 bp, Homo sapiens
cgtgaaaggcaatggctcgctg

SEQ ID NO: 1909 - DNA, 33 bp, Homo sapiens
ggcatcccccgtttcgccttcttgtccacgccg

SEQ ID NO: 1910 - DNA, 22 bp, Homo sapiens
tttcgccttcttgtccacgccg

SEQ ID NO: 1911 - DNA, 27 bp, Homo sapiens
ggctttttcttccgccgtttgctctcg

SEQ ID NO: 1912 - DNA, 22 bp, Homo sapiens
tttcttccgccgtttgctctcg

SEQ ID NO: 1913 - DNA, 24 bp, Homo sapiens
gccgtggttgggcaggaagtggtc

SEQ ID NO: 1914 - DNA, 22 bp, Homo sapiens
ccgtggttgggcaggaagtggt

SEQ ID NO: 1915 - DNA, 31 bp, Homo sapiens
ggcagcagggctgacggcgggaggaacgggc

SEQ ID NO: 1916 - DNA, 22 bp, Homo sapiens
gctgacggcgggaggaacgggc

SEQ ID NO: 1917 - DNA, 37 bp, Homo sapiens
ggattgcacggctcctccacctccctccccacccagt

SEQ ID NO: 1918 - DNA, 23 bp, Homo sapiens
tcctccacctccctccccaccca

SEQ ID NO: 1919 - DNA, 33 bp, Homo sapiens
agaggtcttgtgctctgggcggtgtgcaaatgc

SEQ ID NO: 1920 - DNA, 22 bp, Homo sapiens
gctctgggcggtgtgcaaatgc

SEQ ID NO: 1921 - DNA, 27 bp, Homo sapiens
cccacaaatgccttcccgaataccatg

SEQ ID NO: 1922 - DNA, 22 bp, Homo sapiens
ttcccacaaatgccttcccgaa

SEQ ID NO: 1923 - DNA, 47 bp, Homo sapiens
tctcttctccttcaggaccttgtcggccatggcttttctctcctccc

SEQ ID NO: 1924 - DNA, 24 bp, Homo sapiens
cggccatggcttttctctcctccc

SEQ ID NO: 1925 - DNA, 22 bp, Homo sapiens
ttcaggaccttgtcggccatgg

SEQ ID NO: 1926 - DNA, 36 bp, Homo sapiens
gcatgcctgtgcccctttcggaataacggagtcaat

SEQ ID NO: 1927 - DNA, 22 bp, Homo sapiens
gcatgcctgtgcccctttcgga

SEQ ID NO: 1928 - DNA, 22 bp, Homo sapiens
tgcccctttcggaataacggag

SEQ ID NO: 1929 - DNA, 35 bp, Homo sapiens
ctgagagtcccagcgtccctgccaggtaactgtct

SEQ ID NO: 1930 - DNA, 22 bp, Homo sapiens
gagtcccagcgtccctgccagg

SEQ ID NO: 1931 - DNA, 49 bp, Homo sapiens
ccacaccacaccagggctgtcaccacggcaggcctggatgatgatcacc

SEQ ID NO: 1932 - DNA, 22 bp, Homo sapiens
agggctgtcaccacggcaggcc

SEQ ID NO: 1933 - DNA, 22 bp, Homo sapiens
cggcaggcctggatgatgatca

SEQ ID NO: 1934 - DNA, 54 bp, Homo sapiens
ccacacactcccaatatcctgcgtcccctgtcagcggccatcagctccttgtgc

SEQ ID NO: 1935 - DNA, 22 bp, Homo sapiens
agcggccatcagctccttgtgc

SEQ ID NO: 1936 - DNA, 22 bp, Homo sapiens
cctgcgtcccctgtcagcggcc

SEQ ID NO: 1937 - DNA, 22 bp, Homo sapiens
tcccaatatcctgcgtcccctg

SEQ ID NO: 1938 - DNA, 39 bp, Homo sapiens
ggtttgttctgtaggcttgggcagttggcgttgtcaaag

SEQ ID NO: 1939 - DNA, 22 bp, Homo sapiens
ggcttgggcagttggcgttgtc

SEQ ID NO: 1940 - DNA, 37 bp, Homo sapiens
aacttttctttaccggcatcactctcctcgcacccag

SEQ ID NO: 1941 - DNA, 22 bp, Homo sapiens
cggcatcactctcctcgcaccc

SEQ ID NO: 1942 - DNA, 25 bp, Homo sapiens
ctgggaacaggtagaggtggcggca

SEQ ID NO: 1943 - DNA, 24 bp, Homo sapiens
tgggaacaggtagaggtggcggca

SEQ ID NO: 1944 - DNA, 45 bp, Homo sapiens
ggtgagcaacatatcctccaggtggccttgcttggtctccctcag

SEQ ID NO: 1945 - DNA, 24 bp, Homo sapiens
ggtggccttgcttggtctccctca

SEQ ID NO: 1946 - DNA, 25 bp, Homo sapiens
ccacgaggccgagactgcaacctat

SEQ ID NO: 1947 - DNA, 22 bp, Homo sapiens
ccacgaggccgagactgcaacc

SEQ ID NO: 1948 - DNA, 24 bp, Homo sapiens
cacggcaggcctggatgaagaaca

SEQ ID NO: 1949 - DNA, 27 bp, Homo sapiens
cgcatggcggcagtccctttgaggcag

SEQ ID NO: 1950 - DNA, 22 bp, Homo sapiens
tggcggcagtccctttgaggca

SEQ ID NO: 1951 - DNA, 38 bp, Homo sapiens
ctcatagagcaagagaggcggtggcagcagtgaacaga

SEQ ID NO: 1952 - DNA, 22 bp, Homo sapiens
gcaagagaggcggtggcagcag

SEQ ID NO: 1953 - DNA, 37 bp, Homo sapiens
ccagtagtattcgctccttaaatcgttccctccctct

SEQ ID NO: 1954 - DNA, 25 bp, Homo sapiens
cgctccttaaatcgttccctccctc

SEQ ID NO: 1955 - DNA, 46 bp, Homo sapiens
gactagagtactgtggtccacatcccctccagagcgaaattccagt

SEQ ID NO: 1956 - DNA, 22 bp, Homo sapiens
ggtccacatcccctccagagcg

SEQ ID NO: 1957 - DNA, 41 bp, Homo sapiens
ctgcagtactgaagggaacgcacaggccgcttctggacact

SEQ ID NO: 1958 - DNA, 22 bp, Homo sapiens
ggaacgcacaggccgcttctgg

SEQ ID NO: 1959 - DNA, 44 bp, Homo sapiens
agccaagagtgtccttccactgggtggcgctgcagtactgaagg

SEQ ID NO: 1960 - DNA, 22 bp, Homo sapiens
ccttccactgggtggcgctgca

SEQ ID NO: 1961 - DNA, 30 bp, Homo sapiens
gctgcggtgccttgagcccaaacgagccaa

SEQ ID NO: 1962 - DNA, 22 bp, Homo sapiens
tgcggtgccttgagcccaaacg

SEQ ID NO: 1963 - DNA, 26 bp, Homo sapiens
gatgctccccacgaggctcatttcag

SEQ ID NO: 1964 - DNA, 25 bp, Homo sapiens
gatgctccccacgaggctcatttca

SEQ ID NO: 1965 - DNA, 34 bp, Homo sapiens
gcgactttcatgattcttggcgactggctgaaac

SEQ ID NO: 1966 - DNA, 22 bp, Homo sapiens
atgattcttggcgactggctga

SEQ ID NO: 1967 - DNA, 23 bp, Homo sapiens
cgcggcggcggtggcggtgctgc

SEQ ID NO: 1968 - DNA, 22 bp, Homo sapiens
gcggcggcggtggcggtgctgc

SEQ ID NO: 1969 - DNA, 35 bp, Homo sapiens
agcgcaccacctcgcccgcaccgctcgctgtcttg

SEQ ID NO: 1970 - DNA, 22 bp, Homo sapiens
accacctcgcccgcaccgctcg

SEQ ID NO: 1971 - DNA, 28 bp, Homo sapiens
gctcgtccagcagggcaggcaggcgcgc

SEQ ID NO: 1972 - DNA, 22 bp, Homo sapiens
cgtccagcagggcaggcaggcg

SEQ ID NO: 1973 - DNA, 36 bp, Homo sapiens
ggagaatctccaccttgcactccttgcggttctggg

SEQ ID NO: 1974 - DNA, 22 bp, Homo sapiens
ctccaccttgctcaccttgcgg

SEQ ID NO: 1975 - DNA, 38 bp, Homo sapiens
gcgccctctcctcgccagtgcctcagcctcagccccag

SEQ ID NO: 1976 - DNA, 22 bp, Homo sapiens
cgccagtgcctcagcctcagcc

SEQ ID NO: 1977 - DNA, 28 bp, Homo sapiens
gtggaatcccaccccctaaagtctctgg

SEQ ID NO: 1978 - DNA, 22 bp, Homo sapiens
tcccaccccctaaagtctctgg

SEQ ID NO: 1979 - DNA, 36 bp, Homo sapiens
gtttaataacaaaaaaacagccccacagaactattg

SEQ ID NO: 1980 - DNA, 22 bp, Homo sapiens
caaaaaaacagccccacagaac

SEQ ID NO: 1981 - DNA, 23 bp, Homo sapiens
ggccgccgctgccgcctgctgag

SEQ ID NO: 1982 - DNA, 22 bp, Homo sapiens
gccgccgctgccgcctgctgag

SEQ ID NO: 1983 - DNA, 36 bp, Homo sapiens
aggctgtttttcctaacggacctcacgggactgaag

SEQ ID NO: 1984 - DNA, 22 bp, Homo sapiens
cctaacggacctcacgggactg

SEQ ID NO: 1985 - DNA, 37 bp, Homo sapiens
catgttgtatagcaggctcatcgggtcgtccacaggg

SEQ ID NO: 1986 - DNA, 22 bp, Homo sapiens
gctcatcgggtcgtccacaggg

SEQ ID NO: 1987 - DNA, 41 bp, Homo sapiens
tgatgcaggctgacaatagtgggatgcgagtccagggcgat

SEQ ID NO: 1988 - DNA, 22 bp, Homo sapiens
ggctgacaatagtgggatgcga

SEQ ID NO: 1989 - DNA, 35 bp, Homo sapiens
cgcgagaagggcgagaccgggaggagctggctgcc

SEQ ID NO: 1990 - DNA, 22 bp, Homo sapiens
ggcgagaccgggaggagctggc

SEQ ID NO: 1991 - DNA, 27 bp, Homo sapiens
ggatgcgagtccagggcgatctgcagg

SEQ ID NO: 1992 - DNA, 22 bp, Homo sapiens
tgcgagtccagggcgatctgca

SEQ ID NO: 1993 - DNA, 33 bp, Homo sapiens
gcgtaatggagcgctggttctgcccgggtctct

SEQ ID NO: 1994 - DNA, 22 bp, Homo sapiens
tggagcgctggttctgcccggg

SEQ ID NO: 1995 - DNA, 34 bp, Homo sapiens
ccgtgttgagggtggtcagcggcgtcctggagcg

SEQ ID NO: 1996 - DNA, 22 bp, Homo sapiens
tggtcagcggcgtcctggagcg

SEQ ID NO: 1997 - DNA, 29 bp, Homo sapiens
ctgagattgcagaaggaggagggaaaggg

SEQ ID NO: 1998 - DNA, 23 bp, Homo sapiens
ttgcagaaggaggagggaaaggg

SEQ ID NO: 1999 - DNA, 32 bp, Homo sapiens
ggaattagtgccgccttgttccccaatttgct

SEQ ID NO: 2000 - DNA, 22 bp, Homo sapiens
attagtgccgccttgttcccca

SEQ ID NO: 2001 - DNA, 35 bp, Homo sapiens
agcaaagaagctccccccaccccccgtttttttta

SEQ ID NO: 2002 - DNA, 22 bp, Homo sapiens
gctccccccaccccccgttttt

SEQ ID NO: 2003 - DNA, 41 bp, Homo sapiens
tttgagcttccctgcccctgccagtccgccttagccaacac

SEQ ID NO: 2004 - DNA, 22 bp, Homo sapiens
tgccagtccgccttagccaaca

SEQ ID NO: 2005 - DNA, 39 bp, Homo sapiens
tgcgttccgacaggcagcacaccgcctcgtagcagccgc

SEQ ID NO: 2006 - DNA, 22 bp, Homo sapiens
cacaccgcctcgtagcagccgc

SEQ ID NO: 2007 - DNA, 22 bp, Homo sapiens
cgttccgacaggcagcacaccg

SEQ ID NO: 2008 - DNA, 24 bp, Homo sapiens
ccgcaggcgggagtagcagtggtt

SEQ ID NO: 2009 - DNA, 23 bp, Homo sapiens
cgcaggcgggagtagcagtggtt

SEQ ID NO: 2010 - DNA, 43 bp, Homo sapiens
acctccagcctgataactccgccccccacgctgcccccaccca

SEQ ID NO: 2011 - DNA, 22 bp, Homo sapiens
taactccgccccccacgctgcc

SEQ ID NO: 2012 - DNA, 34 bp, Homo sapiens
tttggtgaagtcaagtgggcagggcgaagttggg

SEQ ID NO: 2013 - DNA, 22 bp, Homo sapiens
aagtgggcagggcgaagttggg

SEQ ID NO: 2014 - DNA, 37 bp, Homo sapiens
tgaacccttctctctccaccccatcccctctcaacca

SEQ ID NO: 2015 - DNA, 22 bp, Homo sapiens
ccaccccatcccctctcaacca

SEQ ID NO: 2016 - DNA, 25 bp, Homo sapiens
cccagacggctgagtgagggtaggg

SEQ ID NO: 2017 - DNA, 22 bp, Homo sapiens
agacggctgagtgagggtaggg

SEQ ID NO: 2018 - DNA, 22 bp, Homo sapiens
gactccccctggctggctttag

SEQ ID NO: 2019 - DNA, 48 bp, Homo sapiens
aatagtgaccaggatgacaccccaccccttttcggtctgcctccctgg

SEQ ID NO: 2020 - DNA, 22 bp, Homo sapiens
ccccttttcggtctgcctccct

SEQ ID NO: 2021 - DNA, 22 bp, Homo sapiens
gaccaggatgacaccccacccc

SEQ ID NO: 2022 - DNA, 25 bp, Homo sapiens
tgctccactcgggcaacagacgctg

SEQ ID NO: 2023 - DNA, 22 bp, Homo sapiens
gctccactcgggcaacagacgc

SEQ ID NO: 2024 - DNA, 34 bp, Homo sapiens
gcagaaagcctaccctgccccgtgtgctgtctgg

SEQ ID NO: 2025 - DNA, 22 bp, Homo sapiens
ccctgccccgtgtgctgtctgg

SEQ ID NO: 2026 - DNA, 24 bp, Homo sapiens
gccatcttttcaccctcctggcgg

SEQ ID NO: 2027 - DNA, 22 bp, Homo sapiens
catcttttcaccctcctggcgg

SEQ ID NO: 2028 - DNA, 32 bp, Homo sapiens
gcctgtcctctcactccgccttgtcccagccg

SEQ ID NO: 2029 - DNA, 22 bp, Homo sapiens
tcactccgccttgtcccagccg

SEQ ID NO: 2030 - DNA, 35 bp, Homo sapiens
cgccccgagcgctcccaatccacccctgctccggc

SEQ ID NO: 2031 - DNA, 22 bp, Homo sapiens
cgctcccaatccacccctgctc

SEQ ID NO: 2032 - DNA, 25 bp, Homo sapiens
cggcgccaccgagcaatccaaacac

SEQ ID NO: 2033 - DNA, 22 bp, Homo sapiens
cgccaccgagcaatccaaacac

SEQ ID NO: 2034 - DNA, 30 bp, Homo sapiens
gcccctcggcactctcttcatcgctgggca

SEQ ID NO: 2035 - DNA, 22 bp, Homo sapiens
cggcactctcttcatcgctggg

SEQ ID NO: 2036 - DNA, 30 bp, Homo sapiens
cggtctggccgactgctgctggatgctggg

SEQ ID NO: 2037 - DNA, 22 bp, Homo sapiens
gccgactgctgctggatgctgg

SEQ ID NO: 2038 - DNA, 41 bp, Homo sapiens
aaacaacaaaacaaagccaagaagccccaacaaccaccgcg

SEQ ID NO: 2039 - DNA, 22 bp, Homo sapiens
agaagccccaacaaccaccgcg

SEQ ID NO: 2040 - DNA, 41 bp, Homo sapiens
aagtaggaaaagagcgggatgggatgggatgggatgggatg

SEQ ID NO: 2041 - DNA, 22 bp, Homo sapiens
agcgggatgggatgggatggga

SEQ ID NO: 2042 - DNA, 22 bp, Homo sapiens
atgggatgggatgggatgggat

SEQ ID NO: 2043 - DNA, 24 bp, Homo sapiens
atgcgcatcctttccaccggcatg

SEQ ID NO: 2044 - DNA, 22 bp, Homo sapiens
gcgcatcctttccaccggcatg

SEQ ID NO: 2045 - DNA, 38 bp, Homo sapiens
ttgttaagccacttgagccccgggatcgtgttggagtt

SEQ ID NO: 2046 - DNA, 22 bp, Homo sapiens
tgagccccgggatcgtgttgga

SEQ ID NO: 2047 - DNA, 38 bp, Homo sapiens
agctcgctcatgctgaccggctgctcgtcgctctacgt

SEQ ID NO: 2048 - DNA, 22 bp, Homo sapiens
tgctgaccggctgctcgtcgct

SEQ ID NO: 2049 - DNA, 32 bp, Homo sapiens
ttgttggaagtgacgaaggacgccatgccggg

SEQ ID NO: 2050 - DNA, 22 bp, Homo sapiens
tgacgaaggacgccatgccggg

SEQ ID NO: 2051 - DNA, 31 bp, Homo sapiens
ggcttaacagctcttgacgcgggcctgggtg

SEQ ID NO: 2052 - DNA, 22 bp, Homo sapiens
cagctcttgacgcgggcctggg

SEQ ID NO: 2053 - DNA, 36 bp, Homo sapiens
ctttttcctttgtaccgcgtggcattcaagcatagc

SEQ ID NO: 2054 - DNA, 22 bp, Homo sapiens
ccgcgtggcattcaagcatagc

SEQ ID NO: 2055 - DNA, 28 bp, Homo sapiens
cgctctgctgtctccgcttccactccac

SEQ ID NO: 2056 - DNA, 22 bp, Homo sapiens
cgctctgctgtctccgcttcca

SEQ ID NO: 2057 - DNA, 25 bp, Homo sapiens
cttcaacagggcacgctctcgctcc

SEQ ID NO: 2058 - DNA, 22 bp, Homo sapiens
caacagggcacgctctcgctcc

SEQ ID NO: 2059 - DNA, 34 bp, Homo sapiens
ccactgagacatcctgccaccttgtgccccaaca

SEQ ID NO: 2060 - DNA, 22 bp, Homo sapiens
cctgccaccttgtgccccaaca

SEQ ID NO: 2061 - DNA, 27 bp, Homo sapiens
gcgttggcatgcagggctgtctttcca

SEQ ID NO: 2062 - DNA, 22 bp, Homo sapiens
gcgttggcatgcagggctgtct

SEQ ID NO: 2063 - DNA, 43 bp, Homo sapiens
ggacccctgtcttcaagaccagcggcctctgagggtgcgttgg

SEQ ID NO: 2064 - DNA, 22 bp, Homo sapiens
gcggcctctgagggtgcgttgg

SEQ ID NO: 2065 - DNA, 42 bp, Homo sapiens
tttctgttctttcaattgcaggtgccgaaattcagccgccag

SEQ ID NO: 2066 - DNA, 22 bp, Homo sapiens
gcaggtgccgaaattcagccgc

SEQ ID NO: 2067 - DNA, 41 bp, Homo sapiens
caaaggatggaggcccaaccgctcgggagctggctgacgtt

SEQ ID NO: 2068 - DNA, 22 bp, Homo sapiens
ccaaccgctcgggagctggctg

SEQ ID NO: 2069 - DNA, 22 bp, Homo sapiens
ggatggaggcccaaccgctcgg

SEQ ID NO: 2070 - DNA, 36 bp, Homo sapiens
cgcagcaggaaggtccccggctgctggtccttcaac

SEQ ID NO: 2071 - DNA, 22 bp, Homo sapiens
cgcagcaggaaggtccccggct

SEQ ID NO: 2072 - DNA, 22 bp, Homo sapiens
caggaaggtccccggctgctgg

SEQ ID NO: 2073 - DNA, 34 bp, Homo sapiens
gaggaactgtgagctcgtcggcgtggtggtgacc

SEQ ID NO: 2074 - DNA, 35 bp, Homo sapiens
cgcttgcggcacttggaggcggcgatgcggttgcg

SEQ ID NO: 2075 - DNA, 22 bp, Homo sapiens
tggaggcggcgatgcggttgcg

SEQ ID NO: 2076 - DNA, 27 bp, Homo sapiens
tcgatgggcgacaacggcgggctctcg

SEQ ID NO: 2077 - DNA, 22 bp, Homo sapiens
atgggcgacaacggcgggctct

SEQ ID NO: 2078 - DNA, 24 bp, Homo sapiens
gcgctgccgccacctgctcactca

SEQ ID NO: 2079 - DNA, 22 bp, Homo sapiens
cgctgccgccacctgctcactc

SEQ ID NO: 2080 - DNA, 33 bp, Homo sapiens
ggtggcggcggcgggaagggcacaggttcggca

SEQ ID NO: 2081 - DNA, 22 bp, Homo sapiens
cgggaagggcacaggttcggca

SEQ ID NO: 2082 - DNA, 26 bp, Homo sapiens
agggtgtttccatcctccgcctcccc

SEQ ID NO: 2083 - DNA, 22 bp, Homo sapiens
ggtgtttccatcctccgcctcc

SEQ ID NO: 2084 - DNA, 37 bp, Homo sapiens
agctggttctgcttgtgtaaatcctccagggccttga

SEQ ID NO: 2085 - DNA, 22 bp, Homo sapiens
tgtaaatcctccagggccttga

SEQ ID NO: 2086 - DNA, 22 bp, Homo sapiens
ttctgcttgtgtaaatcctcca

SEQ ID NO: 2087 - DNA, 30 bp, Homo sapiens
ccagcccgttggactggatgatgaggcgct

SEQ ID NO: 2088 - DNA, 22 bp, Homo sapiens
cgttggactggatgatgaggcg

SEQ ID NO: 2089 - DNA, 40 bp, Homo sapiens
ctcttgagggtcttcactttctcttccaggcgcgagatgc

SEQ ID NO: 2090 - DNA, 22 bp, Homo sapiens
tcttcactttctcttccaggcg

SEQ ID NO: 2091 - DNA, 44 bp, Homo sapiens
agctggcagccgctgttgacgtggctgaggactttctgcttgag

SEQ ID NO: 2092 - DNA, 22 bp, Homo sapiens
cgtggctgaggactttctgctt

SEQ ID NO: 2093 - DNA, 44 bp, Homo sapiens
gactttactgaaaacagaaaaccgggcgaaccaaggattacaaa

SEQ ID NO: 2094 - DNA, 22 bp, Homo sapiens
cgggcgaaccaaggattacaaa

SEQ ID NO: 2095 - DNA, 39 bp, Homo sapiens
ctgaccagaaaagtagctgccgccaccgccgccctctgg

SEQ ID NO: 2096 - DNA, 22 bp, Homo sapiens
aagtagctgccgccaccgccgc

SEQ ID NO: 2097 - DNA, 33 bp, Homo sapiens
cgcgatagctttcctggcgtcgtttcccccagc

SEQ ID NO: 2098 - DNA, 22 bp, Homo sapiens
gctttcctggcgtcgtttcccc

SEQ ID NO: 2099 - DNA, 25 bp, Homo sapiens
agccctcctgctcctcggtgacgcc

SEQ ID NO: 2100 - DNA, 22 bp, Homo sapiens
gccctcctgctcctcggtgacg

SEQ ID NO: 2101 - DNA, 26 bp, Homo sapiens
ggcgtgtgcccagccgtccaagcgag

SEQ ID NO: 2102 - DNA, 22 bp, Homo sapiens
cgtgtgcccagccgtccaagcg

SEQ ID NO: 2103 - DNA, 26 bp, Homo sapiens
gggtccccttcccaatgtccccgcgg

SEQ ID NO: 2104 - DNA, 22 bp, Homo sapiens
ccccttcccaatgtccccgcgg

SEQ ID NO: 2105 - DNA, 21 bp, Homo sapiens
aggcaaacccacagaggcggc

SEQ ID NO: 2106 - DNA, 22 bp, Homo sapiens
taggcaaacccacagaggcggc

SEQ ID NO: 2107 - DNA, 37 bp, Homo sapiens
aggtacttcgcagggattctgacacgctcccccaccg

SEQ ID NO: 2108 - DNA, 23 bp, Homo sapiens
gattctgacacgctcccccaccg

SEQ ID NO: 2109 - DNA, 31 bp, Homo sapiens
cccttgacggaatcgtgcccctttggtcttg

SEQ ID NO: 2110 - DNA, 22 bp, Homo sapiens
cccttgacggaatcgtgcccct

SEQ ID NO: 2111 - DNA, 36 bp, Homo sapiens
aaatgaaaatcaaatgcggctacttcctgctggtgg

SEQ ID NO: 2112 - DNA, 22 bp, Homo sapiens
tgcggctacttcctgctggtgg

SEQ ID NO: 2113 - DNA, 30 bp, Homo sapiens
cggcccgggtctccacgcagagccacaggg

SEQ ID NO: 2114 - DNA, 22 bp, Homo sapiens
gcccgggtctccacgcagagcc

SEQ ID NO: 2115 - DNA, 23 bp, Homo sapiens
cgctcccccaccgtggcttccac

SEQ ID NO: 2116 - DNA, 22 bp, Homo sapiens
cgctcccccaccgtggcttcca

SEQ ID NO: 2117 - DNA, 27 bp, Homo sapiens
gcttggctgggctcgttggcgcactct

SEQ ID NO: 2118 - DNA, 22 bp, Homo sapiens
gcttggctgggctcgttggcgc

SEQ ID NO: 2119 - DNA, 44 bp, Homo sapiens
acaagtagcctgtcttcagttcccctccattggcccgcttaacg

SEQ ID NO: 2120 - DNA, 22 bp, Homo sapiens
cagttcccctccattggcccgc

SEQ ID NO: 2121 - DNA, 35 bp, Homo sapiens
gataagaggatatttcgtgccgccaggtccctgtg

SEQ ID NO: 2122 - DNA, 22 bp, Homo sapiens
ttcgtgccgccaggtccctgtg

SEQ ID NO: 2123 - DNA, 28 bp, Homo sapiens
atatcccgggccaagccaaagtcacaga

SEQ ID NO: 2124 - DNA, 22 bp, Homo sapiens
cccgggccaagccaaagtcaca

SEQ ID NO: 2125 - DNA, 22 bp, Homo sapiens
ctccccgtgccagcagtccagc

SEQ ID NO: 2126 - DNA, 26 bp, Homo sapiens
cgctcgcccgctccgttcaatccccg

SEQ ID NO: 2127 - DNA, 22 bp, Homo sapiens
cgcccgctccgttcaatccccg

SEQ ID NO: 2128 - DNA, 22 bp, Homo sapiens
gccacccgcagcctcacctcgc

SEQ ID NO: 2129 - DNA, 29 bp, Homo sapiens
ggcagacccaagccaacagcccccagtct

SEQ ID NO: 2130 - DNA, 22 bp, Homo sapiens
gcagacccaagccaacagcccc

SEQ ID NO: 2131 - DNA, 34 bp, Homo sapiens
ctctgtagccatcctcttctcagcccccaccagg

SEQ ID NO: 2132 - DNA, 22 bp, Homo sapiens
gccatcctcttctcagccccca

SEQ ID NO: 2133 - DNA, 36 bp, Homo sapiens
gcgctcccggctgttggtgaacacgcgccgggccac

SEQ ID NO: 2134 - DNA, 20 bp, Homo sapiens
cgctcccggctgttggtgaa

SEQ ID NO: 2135 - DNA, 29 bp, Homo sapiens
ccctcagggcttcgcttccgctcccccag

SEQ ID NO: 2136 - DNA, 22 bp, Homo sapiens
ggcttcgcttccgctcccccag

SEQ ID NO: 2137 - DNA, 40 bp, Homo sapiens
cggccccggtttcctccctctcacccctggcggcgcacgg

SEQ ID NO: 2138 - DNA, 22 bp, Homo sapiens
tctcacccctggcggcgcacgg

SEQ ID NO: 2139 - DNA, 22 bp, Homo sapiens
ctccctctcacccctggcggcg

SEQ ID NO: 2140 - DNA, 25 bp, Homo sapiens
gatcccccgctcccctcttacccca

SEQ ID NO: 2141 - DNA, 22 bp, Homo sapiens
cccccgctcccctcttacccca

SEQ ID NO: 2142 - DNA, 41 bp, Homo sapiens
gggagaagtttcagtaggcaaaggcagatggcggggaggcc

SEQ ID NO: 2143 - DNA, 22 bp, Homo sapiens
gtaggcaaaggcagatggcggg

SEQ ID NO: 2144 - DNA, 37 bp, Homo sapiens
gggaggaggactaggtgccccgctcccacctgcttag

SEQ ID NO: 2145 - DNA, 22 bp, Homo sapiens
tgccccgctcccacctgcttag

SEQ ID NO: 2146 - DNA, 33 bp, Homo sapiens
ggcccccaatccccactgccccccaccccagat

SEQ ID NO: 2147 - DNA, 22 bp, Homo sapiens
ccccaatccccactgcccccca

SEQ ID NO: 2148 - DNA, 27 bp, Homo sapiens
cctgttgggtggcggtggttgtgtggg

SEQ ID NO: 2149 - DNA, 22 bp, Homo sapiens
tgggtggcggtggttgtgtggg

SEQ ID NO: 2150 - DNA, 28 bp, Homo sapiens
cgcagcagccgcaccaggaagccgatgt

SEQ ID NO: 2151 - DNA, 22 bp, Homo sapiens
cagcagccgcaccaggaagccg

SEQ ID NO: 2152 - DNA, 26 bp, Homo sapiens
ggacccccgagaccttgcccctgacg

SEQ ID NO: 2153 - DNA, 22 bp, Homo sapiens
ccccgagaccttgcccctgacg

SEQ ID NO: 2154 - DNA, 37 bp, Homo sapiens
gggcggtgagaaaagcgaagcctccccagcccctcct

SEQ ID NO: 2155 - DNA, 22 bp, Homo sapiens
gcgaagcctccccagcccctcc

SEQ ID NO: 2156 - DNA, 29 bp, Homo sapiens
ccgtgaccctgggcccccacctcctctcc

SEQ ID NO: 2157 - DNA, 22 bp, Homo sapiens
ccgtgaccctgggcccccacct

SEQ ID NO: 2158 - DNA, 24 bp, Homo sapiens
cggtcgggcgggtgcgtcggcagc

SEQ ID NO: 2159 - DNA, 22 bp, Homo sapiens
cggtcgggcgggtgcgtcggca

SEQ ID NO: 2160 - DNA, 24 bp, Homo sapiens
catcttgatgggccgggccgctcc

SEQ ID NO: 2161 - DNA, 22 bp, Homo sapiens
tcttgatgggccgggccgctcc

SEQ ID NO: 2162 - DNA, 33 bp, Homo sapiens
cccctcctggcctccccccgcgaccccagcccg

SEQ ID NO: 2163 - DNA, 22 bp, Homo sapiens
cctggcctccccccgcgacccc

SEQ ID NO: 2164 - DNA, 23 bp, Homo sapiens
ggaccaacccccactgcccacgg

SEQ ID NO: 2165 - DNA, 22 bp, Homo sapiens
ggaccaacccccactgcccacg

SEQ ID NO: 2166 - DNA, 30 bp, Homo sapiens
gatgttcatccgaaccgccgccgccattct

SEQ ID NO: 2167 - DNA, 22 bp, Homo sapiens
tcatccgaaccgccgccgccat

SEQ ID NO: 2168 - DNA, 40 bp, Homo sapiens
accatgttcagcttctctctcccgccgctccagatagtcg

SEQ ID NO: 2169 - DNA, 22 bp, Homo sapiens
ctcccgccgctccagatagtcg

SEQ ID NO: 2170 - DNA, 23 bp, Homo sapiens
gcacaagcgaagatgagcccgtc

SEQ ID NO: 2171 - DNA, 22 bp, Homo sapiens
gcacaagcgaagatgagcccgt

SEQ ID NO: 2172 - DNA, 25 bp, Homo sapiens
gcaccagccccttcaacttctccag

SEQ ID NO: 2173 - DNA, 22 bp, Homo sapiens
ccagccccttcaacttctccag

SEQ ID NO: 2174 - DNA, 32 bp, Homo sapiens
tgcctcttcaggtgtcgctgctctcgctgaag

SEQ ID NO: 2175 - DNA, 22 bp, Homo sapiens
ggtgtcgctgctctcgctgaag

SEQ ID NO: 2176 - DNA, 29 bp, Homo sapiens
tcagagtcgctcacactgctgctgctcca

SEQ ID NO: 2177 - DNA, 22 bp, Homo sapiens
cgctcacactgctgctgctcca

SEQ ID NO: 2178 - DNA, 25 bp, Homo sapiens
ctggaatagccctcatcactgccga

SEQ ID NO: 2179 - DNA, 22 bp, Homo sapiens
ggaatagccctcatcactgccg

SEQ ID NO: 2180 - DNA, 22 bp, Homo sapiens
gctggcgggcgggcaggcggca

SEQ ID NO: 2181 - DNA, 29 bp, Homo sapiens
tagccttcaggatggagtggaggtgcggg

SEQ ID NO: 2182 - DNA, 22 bp, Homo sapiens
caggatggagtggaggtgcggg

SEQ ID NO: 2183 - DNA, 30 bp, Homo sapiens
ctcctgcagctccttgaccatctgctcgta

SEQ ID NO: 2184 - DNA, 22 bp, Homo sapiens
gctccttgaccatctgctcgta

SEQ ID NO: 2185 - DNA, 32 bp, Homo sapiens
ctggaagttgaggaaagccaggtctcccttca

SEQ ID NO: 2186 - DNA, 22 bp, Homo sapiens
ggaagttgaggaaagccaggtc

SEQ ID NO: 2187 - DNA, 28 bp, Homo sapiens
ccaagtggagtggagtctgctgcaggtt

SEQ ID NO: 2188 - DNA, 22 bp, Homo sapiens
caagtggagtggagtctgctgc

SEQ ID NO: 2189 - DNA, 36 bp, Homo sapiens
ggacaccaaaagctccacgatgcccaggtagccatg

SEQ ID NO: 2190 - DNA, 22 bp, Homo sapiens
ctccacgatgcccaggtagcca

SEQ ID NO: 2191 - DNA, 34 bp, Homo sapiens
agcattgacatcagcacccaaggacaccaaaagc

SEQ ID NO: 2192 - DNA, 22 bp, Homo sapiens
catcagcacccaaggacaccaa

SEQ ID NO: 2193 - DNA, 30 bp, Homo sapiens
gttgacatcagccccacacttcaacaggag

SEQ ID NO: 2194 - DNA, 22 bp, Homo sapiens
tcagccccacacttcaacagga

SEQ ID NO: 2195 - DNA, 32 bp, Homo sapiens
gtcatagctctcctcatcctcactctctggca

SEQ ID NO: 2196 - DNA, 22 bp, Homo sapiens
tcctcatcctcactctctggca

SEQ ID NO: 2197 - DNA, 34 bp, Homo sapiens
agggcagctcgtcctctgtgaactccgtgaactc

SEQ ID NO: 2198 - DNA, 22 bp, Homo sapiens
gctcgtcctctgtgaactccgt

SEQ ID NO: 2199 - DNA, 37 bp, Homo sapiens
acgctggcctccaaacacacagtcatcatagggcagc

SEQ ID NO: 2200 - DNA, 22 bp, Homo sapiens
gcctccaaacacacagtcatca

SEQ ID NO: 2201 - DNA, 32 bp, Homo sapiens
aagttcacaaaagcaacaaaatgagggctgat

SEQ ID NO: 2202 - DNA, 22 bp, Homo sapiens
acaaaagcaacaaaatgagggc

SEQ ID NO: 2203 - DNA, 31 bp, Homo sapiens
ttgataaccttctccaaaaaccccacaaagg

SEQ ID NO: 2204 - DNA, 22 bp, Homo sapiens
ttctccaaaaaccccacaaagg

SEQ ID NO: 2205 - DNA, 31 bp, Homo sapiens
tctgtgactgcgacgagagcgagcagagagc

SEQ ID NO: 2206 - DNA, 22 bp, Homo sapiens
gcgagcagagcgagcagagagc

SEQ ID NO: 2207 - DNA, 36 bp, Homo sapiens
ccttcaaagtcaatccaatagcagcccgaagatgtc

SEQ ID NO: 2208 - DNA, 22 bp, Homo sapiens
caatccaatagcagcccgaaga

SEQ ID NO: 2209 - DNA, 43 bp, Homo sapiens
acctgattcaaacatgcagccacggcgacccacacagaacctt

SEQ ID NO: 2210 - DNA, 22 bp, Homo sapiens
ccacggcgacccacacagaacc

SEQ ID NO: 2211 - DNA, 38 bp, Homo sapiens
ctgaatcttttttctccccatagtccccgtttttcttc

SEQ ID NO: 2212 - DNA, 22 bp, Homo sapiens
ttttttctccccatagtccccg

SEQ ID NO: 2213 - DNA, 33 bp, Homo sapiens
ccaaactgttgtggctggacactgggatggaga

SEQ ID NO: 2214 - DNA, 22 bp, Homo sapiens
tggctggacactgggatggaga

SEQ ID NO: 2215 - DNA, 25 bp, Homo sapiens
gggattgccatacccgttccctgca

SEQ ID NO: 2216 - DNA, 22 bp, Homo sapiens
gattgccatacccgttccctgc

SEQ ID NO: 2217 - DNA, 38 bp, Homo sapiens
gcatcgtattcttgctgcctggtggaataagaactcgg

SEQ ID NO: 2218 - DNA, 22 bp, Homo sapiens
cgtattcttgctgcctggtgga

SEQ ID NO: 2219 - DNA, 22 bp, Homo sapiens
gcctggtggaataagaactcgg

SEQ ID NO: 2220 - DNA, 22 bp, Homo sapiens
gggtagccactgactgagccga

SEQ ID NO: 2221 - DNA, 35 bp, Homo sapiens
cctgccgtggaagccccgtggagagactggagcgt

SEQ ID NO: 2222 - DNA, 22 bp, Homo sapiens
cctgccgtggaagccccgtgga

SEQ ID NO: 2223 - DNA, 40 bp, Homo sapiens
gcattatgatgagcccgtttgtcagccgcagattgaaacc

SEQ ID NO: 2224 - DNA, 22 bp, Homo sapiens
tgagcccgtttgtcagccgcag

SEQ ID NO: 2225 - DNA, 35 bp, Homo sapiens
tcagttactcaggccccaagaagcaggaccaagcc

SEQ ID NO: 2226 - DNA, 22 bp, Homo sapiens
caggccccaagaagcaggacca

SEQ ID NO: 2227 - DNA, 40 bp, Homo sapiens
agtaaccaacccactgacaccacccactgcccatcccttg

SEQ ID NO: 2228 - DNA, 22 bp, Homo sapiens
gacaccacccactgcccatccc

SEQ ID NO: 2229 - DNA, 36 bp, Homo sapiens
tacaaaacctctatgccacccaaaacaccctccctg

SEQ ID NO: 2230 - DNA, 22 bp, Homo sapiens
tgccacccaaaacaccctccct

SEQ ID NO: 2231 - DNA, 31 bp, Homo sapiens
gccaaacattgccagtcgccgccgccgcctg

SEQ ID NO: 2232 - DNA, 22 bp, Homo sapiens
ttgccagtcgccgccgccgcct

SEQ ID NO: 2233 - DNA, 34 bp, Homo sapiens
ctccttctccgtagccaaaagtcgccctcccggg

SEQ ID NO: 2234 - DNA, 24 bp, Homo sapiens
ccgtagccaaaagtcgccctcccg

SEQ ID NO: 2235 - DNA, 42 bp, Homo sapiens
ccaatcaccgcgccggcctcccctccccctatctctcgccgg

SEQ ID NO: 2236 - DNA, 23 bp, Homo sapiens
cccctccccctatctctcgccgg

SEQ ID NO: 2237 - DNA, 22 bp, Homo sapiens
gcgccggcctcccctcccccta

SEQ ID NO: 2238 - DNA, 22 bp, Homo sapiens
ccaatcaccgcgccggcctccc

SEQ ID NO: 2239 - DNA, 34 bp, Homo sapiens
cgcgcgaccctccgggagtctggcgtgagggtgg

SEQ ID NO: 2240 - DNA, 23 bp, Homo sapiens
ccgggagtctggcgtgagggtgg

SEQ ID NO: 2241 - DNA, 22 bp, Homo sapiens
cgcgcgaccctccgggagtctg

SEQ ID NO: 2242 - DNA, 34 bp, Homo sapiens
ttattaccagattccccgaccaactccagcagcg

SEQ ID NO: 2243 - DNA, 22 bp, Homo sapiens
tccccgaccaactccagcagcg

SEQ ID NO: 2244 - DNA, 46 bp, Homo sapiens
ctcgtcctcctcctcctctgctggcggcggcgtcgagggtagtgac

SEQ ID NO: 2245 - DNA, 22 bp, Homo sapiens
tgctggcggcggcgtcgagggt

SEQ ID NO: 2246 - DNA, 22 bp, Homo sapiens
tcctcctctgctggcggcggcg

SEQ ID NO: 2247 - DNA, 31 bp, Homo sapiens
cgctgcacgccatccccaacccgtcgtaagg

SEQ ID NO: 2248 - DNA, 23 bp, Homo sapiens
cgctgcacgccatccccaacccg

SEQ ID NO: 2249 - DNA, 40 bp, Homo sapiens
accttatggctctgagatgggcaggcagggcagttcttcc

SEQ ID NO: 2250 - DNA, 23 bp, Homo sapiens
tgggcaggcagggcagttcttcc

SEQ ID NO: 2251 - DNA, 23 bp, Homo sapiens
gctctgagatgggcaggcagggc

SEQ ID NO: 2252 - DNA, 32 bp, Homo sapiens
tgtcctaagccctcactgccccaagcccaaaa

SEQ ID NO: 2253 - DNA, 23 bp, Homo sapiens
gccctcactgccccaagcccaaa

SEQ ID NO: 2254 - DNA, 24 bp, Homo sapiens
ggaagaccccgactccttactgga

SEQ ID NO: 2255 - DNA, 31 bp, Homo sapiens
cccccaagccggcccccccacagtagaggtt

SEQ ID NO: 2256 - DNA, 22 bp, Homo sapiens
gccggcccccccacagtagagg

SEQ ID NO: 2257 - DNA, 23 bp, Homo sapiens
cccccaagccggcccccccacac

SEQ ID NO: 2258 - DNA, 35 bp, Homo sapiens
agctcctcttcgggcgacatgatggcgtcagcggc

SEQ ID NO: 2259 - DNA, 23 bp, Homo sapiens
cgggcgacatgatggcgtcagcg

SEQ ID NO: 2260 - DNA, 22 bp, Homo sapiens
gcaggacagccggccgcttccc

SEQ ID NO: 2261 - DNA, 22 bp, Homo sapiens
gcaggacagccggccgcttccc

SEQ ID NO: 2262 - DNA, 35 bp, Homo sapiens
ctgcccattggctttgtgtccttggcgccggtggc

SEQ ID NO: 2263 - DNA, 22 bp, Homo sapiens
ttgtgtccttggcgccggtggc

SEQ ID NO: 2264 - DNA, 22 bp, Homo sapiens
ggctttgtgtccttggcgccgg

SEQ ID NO: 2265 - DNA, 38 bp, Homo sapiens
agttcttcttctttgctcctccattgcggtccccttca

SEQ ID NO: 2266 - DNA, 20 bp, Homo sapiens
gctcctccattgcggtcccc

SEQ ID NO: 2267 - DNA, 22 bp, Homo sapiens
gctcctccattgcggtcccctt

SEQ ID NO: 2268 - DNA, 25 bp, Homo sapiens
tctttgctcctccattgcggtcccc

SEQ ID NO: 2269 - DNA, 23 bp, Homo sapiens
tttgctcctccattgcggtcccc

SEQ ID NO: 2270 - DNA, 18 bp, Homo sapiens
tcctccattgcggtcccc

SEQ ID NO: 2271 - DNA, 25 bp, Homo sapiens
gctactcgaatgagctcaggcttcc

SEQ ID NO: 2272 - DNA, 20 bp, Homo sapiens
tcgaatgagctcaggcttcc

SEQ ID NO: 2273 - DNA, 18 bp, Homo sapiens
tcgaatgagctcaggctt

SEQ ID NO: 2274 - DNA, 22 bp, Homo sapiens
actcgaatgagctcaggcttcc

SEQ ID NO: 2275 - DNA, 23 bp, Homo sapiens
agctcccagctttgcgtgcccct

SEQ ID NO: 2276 - DNA, 20 bp, Homo sapiens
gctcccagctttgcgtgccc

SEQ ID NO: 2277 - DNA, 24 bp, Homo sapiens
tgcgcgctccgggcaacatggtcc

SEQ ID NO: 2278 - DNA, 20 bp, Homo sapiens
gcgcgctccgggcaacatgg

SEQ ID NO: 2279 - DNA, 22 bp, Homo sapiens
cgcgctccgggcaacatggtcc

SEQ ID NO: 2280 - DNA, 18 bp, Homo sapiens
cgcgctccgggcaacatg

SEQ ID NO: 2281 - DNA, 18 bp, Homo sapiens
ctccgggcaacatggtcc

SEQ ID NO: 2282 - DNA, 24 bp, Homo sapiens
ggcctcctttgctgccctcacgat

SEQ ID NO: 2283 - DNA, 22 bp, Homo sapiens
gcctcctttgctgccctcacga

SEQ ID NO: 2284 - DNA, 39 bp, Homo sapiens
gccaaggggcgggatgatgatggcggcgatgggcgtggc

SEQ ID NO: 2285 - DNA, 20 bp, Homo sapiens
gcgggatgatgatggcggcg

SEQ ID NO: 2286 - DNA, 70 bp, Homo sapiens
cccgggccaggctcacgcgctgcttctggcccccagacaggttcacgcccttctcgccaatctctgtccg

SEQ ID NO: 2287 - DNA, 20 bp, Homo sapiens
gggccaggctcacgcgctgc

SEQ ID NO: 2288 - DNA, 45 bp, Homo sapiens
gcaactttaagatctgcggcccggaaaacatcatcaggtcgtgga

SEQ ID NO: 2289 - DNA, 20 bp, Homo sapiens
ctgcggcccggaaaacatca

SEQ ID NO: 2290 - DNA, 92 bp, Homo sapiens
atgccattctccatttgctttgcttccttccctggaccgctgacgcccgtgaccccgttctcctctgcatcctgctcctcgtctgtgctggc

SEQ ID NO: 2291 - DNA, 20 bp, Homo sapiens
ccctggaccgctgacgcccg

SEQ ID NO: 2292 - DNA, 26 bp, Homo sapiens
gccggtgggcgatggtgagacggtgc

SEQ ID NO: 2293 - DNA, 22 bp, Homo sapiens
ccggtgggcgatggtgaggacg

SEQ ID NO: 2294 - DNA, 26 bp, Homo sapiens
aagccatgacttctctgccctacgta

SEQ ID NO: 2295 - DNA, 22 bp, Homo sapiens
catgacttctctgccctacgta

SEQ ID NO: 2296 - DNA, 39 bp, Homo sapiens
gaggcacagcgggcgactccttgggcggcttcttgtcgg

SEQ ID NO: 2297 - DNA, 21 bp, Homo sapiens
cgggcgactccttgggcggct

SEQ ID NO: 2298 - DNA, 26 bp, Homo sapiens
cacgggcgggatgggaagcacaggtc

SEQ ID NO: 2299 - DNA, 21 bp, Homo sapiens
gcgggatgggaagcacaggtc

SEQ ID NO: 2300 - DNA, 34 bp, Homo sapiens
gaggcacagcgggcgactccttgggcggcttctt

SEQ ID NO: 2301 - DNA, 22 bp, Homo sapiens
cgggcgactccttgggcggctt

SEQ ID NO: 2302 - DNA, 35 bp, Homo sapiens
aaaaatatgtgtgggcgtgggcgggagataggaac

SEQ ID NO: 2303 - DNA, 22 bp, Homo sapiens
tgtgtgggcgtgggcgggagat

SEQ ID NO: 2304 - DNA, 46 bp, Homo sapiens
gagccaggtcctagggagggagcaggcggaggagcagacggagctg

SEQ ID NO: 2305 - DNA, 23 bp, Homo sapiens
gcaggcggaggagcagacggagc

SEQ ID NO: 2306 - DNA, 23 bp, Homo sapiens
ggtcctagggagggagcaggcgg

SEQ ID NO: 2307 - DNA, 32 bp, Homo sapiens
aggcccatctcctcctccccctgcagtagtgc

SEQ ID NO: 2308 - DNA, 23 bp, Homo sapiens
ggcccatctcctcctccccctgg

SEQ ID NO: 2309 - DNA, 36 bp, Homo sapiens
aaatgaaaacgtaatgacttgtctccgcggctcccg

SEQ ID NO: 2310 - DNA, 22 bp, Homo sapiens
tgacttgtctccgcggctcccg

SEQ ID NO: 2311 - DNA, 36 bp, Homo sapiens
tggtgaaattgtgctgaggtcctggccctgggtcgt

SEQ ID NO: 2312 - DNA, 23 bp, Homo sapiens
gctgaggtcctggccctgggtcg

SEQ ID NO: 2313 - DNA, 43 bp, Homo sapiens
gggctgaagagaaagtctgcgctgggagctgcaggctgggccc

SEQ ID NO: 2314 - DNA, 22 bp, Homo sapiens
cgctgggagctgcaggctgggc

SEQ ID NO: 2315 - DNA, 23 bp, Homo sapiens
gaaagtctgcgctgggagctgca

SEQ ID NO: 2316 - DNA, 48 bp, Homo sapiens
ctgcccgatccacaaagaccccagtgcaagcgatgggcagcatcagat

SEQ ID NO: 2317 - DNA, 22 bp, Homo sapiens
ccagtgcaagcgatgggcagca

SEQ ID NO: 2318 - DNA, 25 bp, Homo sapiens
tccacaaagaccccagtgcaagcga

SEQ ID NO: 2319 - DNA, 43 bp, Homo sapiens
ggaaaattcactgcgatctgcaagccctggcaaccaaccgaga

SEQ ID NO: 2320 - DNA, 22 bp, Homo sapiens
tgcaagccctggcaaccaaccg

SEQ ID NO: 2321 - DNA, 25 bp, Homo sapiens
tcactgcgatctgcaagccctggca

SEQ ID NO: 2322 - DNA, 36 bp, Homo sapiens
ggtaatgccacagcaccctccaccagcccagcctga

SEQ ID NO: 2323 - DNA, 22 bp, Homo sapiens
gcaccctccaccagcccagcct

SEQ ID NO: 2324 - DNA, 53 bp, Homo sapiens
tagcacatctggcccccaccagcctccccttctccttccccagccctggcctc

SEQ ID NO: 2325 - DNA, 22 bp, Homo sapiens
ttctccttccccagccctggcc

SEQ ID NO: 2326 - DNA, 22 bp, Homo sapiens
gcccccaccagcctccccttct

SEQ ID NO: 2327 - DNA, 26 bp, Homo sapiens
gccccgcccttgccattcttttccct

SEQ ID NO: 2328 - DNA, 22 bp, Homo sapiens
gccccgcccttgccattctttt

SEQ ID NO: 2329 - DNA, 37 bp, Homo sapiens
catatccctcagtccccaacccacgcccccagagtct

SEQ ID NO: 2330 - DNA, 22 bp, Homo sapiens
cagtccccaacccacgccccca

SEQ ID NO: 2331 - DNA, 40 bp, Homo sapiens
tctgacctatttataccccagccaggccctgcccatagca

SEQ ID NO: 2332 - DNA, 22 bp, Homo sapiens
accccagccaggccctgcccat

SEQ ID NO: 2333 - DNA, 40 bp, Homo sapiens
ttcctttgcttcctgctcccgagtgcgcaacccagcaaac

SEQ ID NO: 2334 - DNA, 22 bp, Homo sapiens
gctcccgagtgcgcaacccagc

SEQ ID NO: 2335 - DNA, 42 bp, Homo sapiens
tgcagaggccatgcaccttctcgagctgggctgctgcgtgca

SEQ ID NO: 2336 - DNA, 22 bp, Homo sapiens
tcgagctgggctgctgcgtgca

SEQ ID NO: 2337 - DNA, 38 bp, Homo sapiens
gttcaatgtgtttccaccccaggcagccacccactgat

SEQ ID NO: 2338 - DNA, 22 bp, Homo sapiens
ttccaccccaggcagccaccca

SEQ ID NO: 2339 - DNA, 42 bp, Homo sapiens
atggcaagagtcagacagtcccggtccggatggcagttgtgt

SEQ ID NO: 2340 - DNA, 22 bp, Homo sapiens
cccggtccggatggcagttgtg

SEQ ID NO: 2341 - DNA, 26 bp, Homo sapiens
accggtcgggtgagagtggcagggtc

SEQ ID NO: 2342 - DNA, 23 bp, Homo sapiens
ccggtcgggtgagagtggcaggg

SEQ ID NO: 2343 - DNA, 27 bp, Homo sapiens
aaaataaagtcgttgtgggcggctggg

SEQ ID NO: 2344 - DNA, 20 bp, Homo sapiens
agtcgttgtgggcggctggg

SEQ ID NO: 2345 - DNA, 25 bp, Homo sapiens
gcaggtatgggagatgccggccggg

SEQ ID NO: 2346 - DNA, 22 bp, Homo sapiens
ggtatgggagatgccggccggg

SEQ ID NO: 2347 - DNA, 23 bp, Homo sapiens
agcagcagcagctccgccacgcg

SEQ ID NO: 2348 - DNA, 22 bp, Homo sapiens
gcagcagcagctccgccacgcg

SEQ ID NO: 2349 - DNA, 25 bp, Homo sapiens
tccgcgccgtggagcagcagcagct

SEQ ID NO: 2350 - DNA, 22 bp, Homo sapiens
ccgcgccgtggagcagcagcag

SEQ ID NO: 2351 - DNA, 31 bp, Homo sapiens
ccctcccgggcagcatcatgcaccggtcggg

SEQ ID NO: 2352 - DNA, 24 bp, Homo sapiens
gggcagcatcatgcaccggtcggg

SEQ ID NO: 2353 - DNA, 22 bp, Homo sapiens
ccctcccgggcagcatcatgca

SEQ ID NO: 2354 - DNA, 26 bp, Homo sapiens
cgcgccccggcccggtgcagcaccac

SEQ ID NO: 2355 - DNA, 21 bp, Homo sapiens
gcgccccggcccggtgcagca

SEQ ID NO: 2356 - DNA, 27 bp, Homo sapiens
accccaggcatcgcgcacgtccagccg

SEQ ID NO: 2357 - DNA, 22 bp, Homo sapiens
aggcatcgcgcacgtccagccg

SEQ ID NO: 2358 - DNA, 29 bp, Homo sapiens
caggtaccctgcaacgtcgcggtggcccc

SEQ ID NO: 2359 - DNA, 22 bp, Homo sapiens
cctgcaacgtcgcggtggcccc

SEQ ID NO: 2360 - DNA, 41 bp, Homo sapiens
ggaacctggcgtcagtcccccgtggctgtgcgcaggtaccc

SEQ ID NO: 2361 - DNA, 21 bp, Homo sapiens
tcccccgtggctgtgcgcagg

SEQ ID NO: 2362 - DNA, 41 bp, Homo sapiens
aggcctcttggagaccttacccctggctgtttggactttgt

SEQ ID NO: 2363 - DNA, 22 bp, Homo sapiens
ttggagaccttacccctggctg

SEQ ID NO: 2364 - DNA, 27 bp, Homo sapiens
gggcctctccgcactcccttaccctgg

SEQ ID NO: 2365 - DNA, 22 bp, Homo sapiens
gcctctccgcactcccttaccc

SEQ ID NO: 2366 - DNA, 44 bp, Homo sapiens
gcagtgctggtgttgctcgtcccgctgctgtgtttctgtgcccg

SEQ ID NO: 2367 - DNA, 22 bp, Homo sapiens
ggtgttgctcgtcccgctgctg

SEQ ID NO: 2368 - DNA, 31 bp, Homo sapiens
aaccctcgtcactcccaatactcggcaggct

SEQ ID NO: 2369 - DNA, 22 bp, Homo sapiens
tcactcccaatactcggcaggc

SEQ ID NO: 2370 - DNA, 31 bp, Homo sapiens
cctaagggcagcaggatggagaggtggcagc

SEQ ID NO: 2371 - DNA, 22 bp, Homo sapiens
ggcagcaggatggagaggtggc

SEQ ID NO: 2372 - DNA, 28 bp, Homo sapiens
tggcccccccaatccatactcataggcc

SEQ ID NO: 2373 - DNA, 23 bp, Homo sapiens
ggcccccccaatccatactcata

SEQ ID NO: 2374 - DNA, 27 bp, Homo sapiens
tctgacccacgcagacaaagaggcaca

SEQ ID NO: 2375 - DNA, 22 bp, Homo sapiens
cccacgcagacaaagaggcaca

SEQ ID NO: 2376 - DNA, 34 bp, Homo sapiens
cgtcagacgctgggtgaaggaggaggcaccagca

SEQ ID NO: 2377 - DNA, 22 bp, Homo sapiens
acgctgggtgaaggaggaggca

SEQ ID NO: 2378 - DNA, 48 bp, Homo sapiens
aaaatgatggtctcagcaaatgcagggaagtgggtgggtctcggaggc

SEQ ID NO: 2379 - DNA, 22 bp, Homo sapiens
gcagggaagtgggtgggtctcg

SEQ ID NO: 2380 - DNA, 31 bp, Homo sapiens
aaaatcgtttttggaagggctgtagggcaag

SEQ ID NO: 2381 - DNA, 22 bp, Homo sapiens
tttttggaagggctgtagggca

SEQ ID NO: 2382 - DNA, 49 bp, Homo sapiens
cagggacctgaaactgaccaaagaggcagacggaggcgacaatgcaggg

SEQ ID NO: 2383 - DNA, 22 bp, Homo sapiens
ccaaagaggcagacggaggcga

SEQ ID NO: 2384 - DNA, 42 bp, Homo sapiens
gggcttacactacctggacctgcggagatgctgcctagctgc

SEQ ID NO: 2385 - DNA, 22 bp, Homo sapiens
tggacctgcggagatgctgcct

SEQ ID NO: 2386 - DNA, 47 bp, Homo sapiens
ccacatacatcgcaacggccgcccctaaccaccccgcccccagtgct

SEQ ID NO: 2387 - DNA, 22 bp, Homo sapiens
gccgcccctaaccaccccgccc

SEQ ID NO: 2388 - DNA, 28 bp, Homo sapiens
cactctccgatgctcttccaggcgcgcg

SEQ ID NO: 2389 - DNA, 22 bp, Homo sapiens
ctctccgatgctcttccaggcg

SEQ ID NO: 2390 - DNA, 22 bp, Homo sapiens
ccgatgctcttccaggcgcgcg

SEQ ID NO: 2391 - DNA, 27 bp, Homo sapiens
actcaccgcagtggtagggcttttcgc

SEQ ID NO: 2392 - DNA, 22 bp, Homo sapiens
ccgcagtggtagggcttttcgc

SEQ ID NO: 2393 - DNA, 40 bp, Homo sapiens
cgtgtggatgcgccggtgctgggtgaggttggcgtgctgc

SEQ ID NO: 2394 - DNA, 22 bp, Homo sapiens
cggtgctgggtgaggttggcgt

SEQ ID NO: 2395 - DNA, 33 bp, Homo sapiens
gaagggcttctctcgtcggtgggtgcgcagatg

SEQ ID NO: 2396 - DNA, 22 bp, Homo sapiens
gcttctctcgtcggtgggtgcg

SEQ ID NO: 2397 - DNA, 42 bp, Homo sapiens
cttcctttactgcattattccccaggcggtgtgcagtctgtg

SEQ ID NO: 2398 - DNA, 22 bp, Homo sapiens
tccccaggcggtgtgcagtctg

SEQ ID NO: 2399 - DNA, 52 bp, Homo sapiens
ggcctgagtggatgtattcgttgcggctcgtgcttctgaggacggccaggcc

SEQ ID NO: 2400 - DNA, 22 bp, Homo sapiens
tgcttctgaggacggccaggcc

SEQ ID NO: 2401 - DNA, 24 bp, Homo sapiens
gcggctcgtgcttctgaggacggc

SEQ ID NO: 2402 - DNA, 35 bp, Homo sapiens
gggctgtcttcgggcggctcctccagcttctccct

SEQ ID NO: 2403 - DNA, 22 bp, Homo sapiens
ggcggctcctccagcttctccc

SEQ ID NO: 2404 - DNA, 22 bp, Homo sapiens
gggctgtcttcgggcggctcct

SEQ ID NO: 2405 - DNA, 31 bp, Homo sapiens
gggagggctgggctgttgagggcgatggagc

SEQ ID NO: 2406 - DNA, 22 bp, Homo sapiens
agggctgggctgttgagggcga

SEQ ID NO: 2407 - DNA, 31 bp, Homo sapiens
atttggtgtctgtgcggtgaagaaggctggg

SEQ ID NO: 2408 - DNA, 22 bp, Homo sapiens
ctgtgcggtgaagaaggctggg

SEQ ID NO: 2409 - DNA, 27 bp, Homo sapiens
gaagttggagcagtcaggccgagccgg

SEQ ID NO: 2410 - DNA, 22 bp, Homo sapiens
tggagcagtcaggccgagccgg

SEQ ID NO: 2411 - DNA, 31 bp, Homo sapiens
gggaatttctaggaggacccgggcgaaagcc

SEQ ID NO: 2412 - DNA, 22 bp, Homo sapiens
ctaggaggacccgggcgaaagc

SEQ ID NO: 2413 - DNA, 30 bp, Homo sapiens
gcctcgcggccctccggagacaccttgcag

SEQ ID NO: 2414 - DNA, 22 bp, Homo sapiens
gcctcgcggccctccggagaca

SEQ ID NO: 2415 - DNA, 30 bp, Homo sapiens
ggacgccgccgcagcctctgacgtggaagg

SEQ ID NO: 2416 - DNA, 22 bp, Homo sapiens
cgccgccgcagcctctgacgtg

SEQ ID NO: 2417 - DNA, 43 bp, Homo sapiens
attaaagaggagatcttggccgagacggacgaggccaggaagg

SEQ ID NO: 2418 - DNA, 22 bp, Homo sapiens
ccgagacggacgaggccaggaa

SEQ ID NO: 2419 - DNA, 22 bp, Homo sapiens
atcttggccgagacggacgagg

SEQ ID NO: 2420 - DNA, 29 bp, Homo sapiens
tccagggaatcggagtcatggcaggcggc

SEQ ID NO: 2421 - DNA, 22 bp, Homo sapiens
aatcggagtcatggcaggcggc

SEQ ID NO: 2422 - DNA, 33 bp, Homo sapiens
cccttgcagcctggcaggactcagcggagcaac

SEQ ID NO: 2423 - DNA, 22 bp, Homo sapiens
gcagcctggcaggactcagcgg

SEQ ID NO: 2424 - DNA, 33 bp, Homo sapiens
gggaactggaacagcgtgcttggcccttgcagc

SEQ ID NO: 2425 - DNA, 22 bp, Homo sapiens
cagcgtgcttggcccttgcagc

SEQ ID NO: 2426 - DNA, 36 bp, Homo sapiens
gggagtggagcagcgggcggaggcacaggagaagtg

SEQ ID NO: 2427 - DNA, 22 bp, Homo sapiens
tggagcagcgggcggaggcaca

SEQ ID NO: 2428 - DNA, 46 bp, Homo sapiens
gcgcgggccccaaagtttctcctctcccgaagaccgcagccgcagg

SEQ ID NO: 2429 - DNA, 22 bp, Homo sapiens
tcccgaagaccgcagccgcagg

SEQ ID NO: 2430 - DNA, 28 bp, Homo sapiens
gggacgcgggtctggaggagcgggcacc

SEQ ID NO: 2431 - DNA, 22 bp, Homo sapiens
gcgggtctggaggagcgggcac

SEQ ID NO: 2432 - DNA, 22 bp, Homo sapiens
gccgcccttcctgatgtgctgg

SEQ ID NO: 2433 - DNA, 30 bp, Homo sapiens
ccagtccagggcgggcagggtcgggctcat

SEQ ID NO: 2434 - DNA, 22 bp, Homo sapiens
tccagggcgggcagggtcgggc

SEQ ID NO: 2435 - DNA, 47 bp, Homo sapiens
ggctgccctccgtctcgtagtgggctcggtggtgggacttgggctgc

SEQ ID NO: 2436 - DNA, 22 bp, Homo sapiens
ggctcggtggtgggacttgggc

SEQ ID NO: 2437 - DNA, 29 bp, Homo sapiens
ggtcgtccgccgtcccaatgaaaagctgc

SEQ ID NO: 2438 - DNA, 22 bp, Homo sapiens
ggtcgtccgccgtcccaatgaa

SEQ ID NO: 2439 - DNA, 26 bp, Homo sapiens
gaccatcttcttcccgcccacgaccg

SEQ ID NO: 2440 - DNA, 22 bp, Homo sapiens
atcttcttcccgcccacgaccg

SEQ ID NO: 2441 - DNA, 33 bp, Homo sapiens
agtatgcaacccccgccccccacccccaacagg

SEQ ID NO: 2442 - DNA, 19 bp, Homo sapiens
gccccccacccccaacagg

SEQ ID NO: 2443 - DNA, 36 bp, Homo sapiens
ggtccccttcccagtcccgtgcgcggctctgactcg

SEQ ID NO: 2444 - DNA, 22 bp, Homo sapiens
ccttcccagtcccgtgcgcggc

SEQ ID NO: 2445 - DNA, 22 bp, Homo sapiens
tcccgtgcgcggctctgactcg

SEQ ID NO: 2446 - DNA, 48 bp, Homo sapiens
ctctgagctgtcgccgctgcgtcgctgctgctgctgccgccgctgccg

SEQ ID NO: 2447 - DNA, 22 bp, Homo sapiens
gctgctgctgccgccgctgccg

SEQ ID NO: 2448 - DNA, 22 bp, Homo sapiens
cgccgctgcgtcgctgctgctg

SEQ ID NO: 2449 - DNA, 37 bp, Homo sapiens
ccacttccatggatttaaaggcaggcggcggcggcgg

SEQ ID NO: 2450 - DNA, 22 bp, Homo sapiens
tttaaaggcaggcggcggcggc

SEQ ID NO: 2451 - DNA, 44 bp, Homo sapiens
gccgccttgccgccgtacgcagcagccaagcagtccgcctcgta

SEQ ID NO: 2452 - DNA, 22 bp, Homo sapiens
cgcagcagccaagcagtccgcc

SEQ ID NO: 2453 - DNA, 22 bp, Homo sapiens
ttgccgccgtacgcagcagcca

SEQ ID NO: 2454 - DNA, 29 bp, Homo sapiens
ccgggcgggctggacgaggaggacgtgga

SEQ ID NO: 2455 - DNA, 22 bp, Homo sapiens
cgggctggacgaggaggacgtg

SEQ ID NO: 2456 - DNA, 30 bp, Homo sapiens
gcaggtgcgcggcctccctgctctgagctg

SEQ ID NO: 2457 - DNA, 22 bp, Homo sapiens
ggtgcgcggcctccctgctctg

SEQ ID NO: 2458 - DNA, 31 bp, Homo sapiens
tgggtcccaggccaccaggcgttgcatgaac

SEQ ID NO: 2459 - DNA, 22 bp, Homo sapiens
tcccaggccaccaggcgttgca

SEQ ID NO: 2460 - DNA, 31 bp, Homo sapiens
gccgccttgccgccgtacgcagcagccaagc

SEQ ID NO: 2461 - DNA, 22 bp, Homo sapiens
cgccttgccgccgtacgcagca

SEQ ID NO: 2462 - DNA, 23 bp, Homo sapiens
cgtggtcgccgatgctgcccagc

SEQ ID NO: 2463 - DNA, 22 bp, Homo sapiens
cgtggtcgccgatgctgcccag

SEQ ID NO: 2464 - DNA, 43 bp, Homo sapiens
cgcccagcggctccaggtacgggctgaagtcgatggcgcgctc

SEQ ID NO: 2465 - DNA, 22 bp, Homo sapiens
cgggctgaagtcgatggcgcgc

SEQ ID NO: 2466 - DNA, 22 bp, Homo sapiens
gcgcccagcggctccaggtacg

SEQ ID NO: 2467 - DNA, 35 bp, Homo sapiens
gcggagccgcctcgaaggtgtccgtggccgtggcg

SEQ ID NO: 2468 - DNA, 22 bp, Homo sapiens
cgaaggtgtccgtggccgtggc

SEQ ID NO: 2469 - DNA, 22 bp, Homo sapiens
cggagccgcctcgaaggtgtcc

SEQ ID NO: 2470 - DNA, 48 bp, Homo sapiens
ggtgcagcgcgcccttggcagcccccaggcgccccaggctcacgtagc

SEQ ID NO: 2471 - DNA, 22 bp, Homo sapiens
ccccaggcgccccaggctcacg

SEQ ID NO: 2472 - DNA, 22 bp, Homo sapiens
gcccttggcagcccccaggcgc

SEQ ID NO: 2473 - DNA, 22 bp, Homo sapiens
tgcagcgcgcccttggcagccc

SEQ ID NO: 2474 - DNA, 25 bp, Homo sapiens
gctcgaagcccggctccgccttgag

SEQ ID NO: 2475 - DNA, 22 bp, Homo sapiens
tcgaagcccggctccgccttga

SEQ ID NO: 2476 - DNA, 27 bp, Homo sapiens
ggcctcctccttccgcttgcagtccgc

SEQ ID NO: 2477 - DNA, 22 bp, Homo sapiens
cctccttccgcttgcagtccgc

SEQ ID NO: 2478 - DNA, 23 bp, Homo sapiens
gggaagcccgccgccatgcctgc

SEQ ID NO: 2479 - DNA, 22 bp, Homo sapiens
ggaagcccgccgccatgcctgc

SEQ ID NO: 2480 - DNA, 41 bp, Homo sapiens
gccgctcggcaccgcctggtagccgaggtaagcgcgcagcg

SEQ ID NO: 2481 - DNA, 22 bp, Homo sapiens
ccgctcggcaccgcctggtagc

SEQ ID NO: 2482 - DNA, 22 bp, Homo sapiens
tagccgaggtaagcgcgcagcg

SEQ ID NO: 2483 - DNA, 39 bp, Homo sapiens
tcttcttggccttgctcttgacctgcgagggcgccggcc

SEQ ID NO: 2484 - DNA, 22 bp, Homo sapiens
tcttgacctgcgagggcgccgg

SEQ ID NO: 2485 - DNA, 47 bp, Homo sapiens
cggctcttgcgcacggcgatgttgttgcgctcgcgccggatcttgta

SEQ ID NO: 2486 - DNA, 22 bp, Homo sapiens
cgatgttgttgcgctcgcgccg

SEQ ID NO: 2487 - DNA, 22 bp, Homo sapiens
cggctcttgcgcacggcgatgt

SEQ ID NO: 2488 - DNA, 28 bp, Homo sapiens
gggccgcgctagcagtggccggaggagg

SEQ ID NO: 2489 - DNA, 22 bp, Homo sapiens
cgcgctagcagtggccggagga

SEQ ID NO: 2490 - DNA, 46 bp, Homo sapiens
atttcttctttatacaccacgggcgggagccatctgcatgtacggt

SEQ ID NO: 2491 - DNA, 22 bp, Homo sapiens
cgggagccatctgcatgtacgg

SEQ ID NO: 2492 - DNA, 22 bp, Homo sapiens
ccacgggcgggagccatctgca

SEQ ID NO: 2493 - DNA, 38 bp, Homo sapiens
gcccagccccgccgccttttctagccccggctgacgtg

SEQ ID NO: 2494 - DNA, 22 bp, Homo sapiens
ttttctagccccggctgacgtg

SEQ ID NO: 2495 - DNA, 22 bp, Homo sapiens
cccgccgccttttctagccccg

SEQ ID NO: 2496 - DNA, 22 bp, Homo sapiens
gcccagccccgccgccttttct

SEQ ID NO: 2497 - DNA, 26 bp, Homo sapiens
cgccgcccgccttgtgattgctgttg

SEQ ID NO: 2498 - DNA, 22 bp, Homo sapiens
cgccgcccgccttgtgattgct

SEQ ID NO: 2499 - DNA, 25 bp, Homo sapiens
gggccgccgggaagaagctccaggg

SEQ ID NO: 2500 - DNA, 22 bp, Homo sapiens
gggccgccgggaagaagctcca

SEQ ID NO: 2501 - DNA, 41 bp, Homo sapiens
cggcggctctggcgtcggcagcagggcgtccgctccgggcc

SEQ ID NO: 2502 - DNA, 22 bp, Homo sapiens
ggcagcagggcgtccgctccgg

SEQ ID NO: 2503 - DNA, 22 bp, Homo sapiens
cggcggctctggcgtcggcagc

SEQ ID NO: 2504 - DNA, 40 bp, Homo sapiens
gcgtcgggccgggctctgcgtccaagcgaggctgtcacct

SEQ ID NO: 2505 - DNA, 22 bp, Homo sapiens
cgtcgggccgggctctgcgtcc

SEQ ID NO: 2506 - DNA, 22 bp, Homo sapiens
gcgtccaagcgaggctgtcacc

SEQ ID NO: 2507 - DNA, 35 bp, Homo sapiens
cgcccggcccggttcgtagaagggcgcaggctccg

SEQ ID NO: 2508 - DNA, 22 bp, Homo sapiens
tcgtagaagggcgcaggctccg

SEQ ID NO: 2509 - DNA, 22 bp, Homo sapiens
cgcccggcccggttcgtagaag

SEQ ID NO: 2510 - DNA, 52 bp, Homo sapiens
gctcgtcgtggcacagctccagggtgggcacggcggccatggagtcgatgta

SEQ ID NO: 2511 - DNA, 22 bp, Homo sapiens
gcacggcggccatggagtcgat

SEQ ID NO: 2512 - DNA, 22 bp, Homo sapiens
gctccagggtgggcacggcggc

SEQ ID NO: 2513 - DNA, 22 bp, Homo sapiens
tcgtcgtggcacagctccaggg

SEQ ID NO: 2514 - DNA, 29 bp, Homo sapiens
gctgccctgcggccgccaagctcaccacg

SEQ ID NO: 2515 - DNA, 22 bp, Homo sapiens
cctgcggccgccaagctcacca

SEQ ID NO: 2516 - DNA, 25 bp, Homo sapiens
cccctcttgccggcgctcttctccc

SEQ ID NO: 2517 - DNA, 22 bp, Homo sapiens
cccctcttgccggcgctcttct

SEQ ID NO: 2518 - DNA, 24 bp, Homo sapiens
cggctcttgcgcacggcgatgttg

SEQ ID NO: 2519 - DNA, 22 bp, Homo sapiens
cggctcttgcgcacggcgatgt

SEQ ID NO: 2520 - DNA, 39 bp, Homo sapiens
ttctgctgcatctcctggttgcgccgcttggccttgtcg

SEQ ID NO: 2521 - DNA, 22 bp, Homo sapiens
ctcctggttgcgccgcttggcc

SEQ ID NO: 2522 - DNA, 24 bp, Homo sapiens
cgcgcgttaccggcagtctgctgt

SEQ ID NO: 2523 - DNA, 23 bp, Homo sapiens
cgcgcgttaccggcagtctgctg

SEQ ID NO: 2524 - DNA, 23 bp, Homo sapiens
cgagggctgcggcggctggcggc

SEQ ID NO: 2525 - DNA, 22 bp, Homo sapiens
cgagggctgcggcggctggcgg

SEQ ID NO: 2526 - DNA, 28 bp, Homo sapiens
gcagcgcggcggagggaacggcagggcc

SEQ ID NO: 2527 - DNA, 22 bp, Homo sapiens
gcggcggagggaacggcagggc

SEQ ID NO: 2528 - DNA, 38 bp, Homo sapiens
gggcctgccggctggagaaggaagaggcggcggcaggc

SEQ ID NO: 2529 - DNA, 22 bp, Homo sapiens
gaaggaagaggcggcggcaggc

SEQ ID NO: 2530 - DNA, 22 bp, Homo sapiens
gggcctgccggctggagaagga

SEQ ID NO: 2531 - DNA, 42 bp, Homo sapiens
gacctgtacttccagtgccccctcctccaccgccactaccaa

SEQ ID NO: 2532 - DNA, 22 bp, Homo sapiens
agtgccccctcctccaccgcca

SEQ ID NO: 2533 - DNA, 34 bp, Homo sapiens
gctcaggtcgcccccagccctcagcaaatcctcc

SEQ ID NO: 2534 - DNA, 22 bp, Homo sapiens
ggtcggccccagccctcagcaa

SEQ ID NO: 2535 - DNA, 35 bp, Homo sapiens
cttgtggaggcaggcgagagaggcagcgagtgggc

SEQ ID NO: 2536 - DNA, 25 bp, Homo sapiens
tggaggcaggcgagagaggcagcga

SEQ ID NO: 2537 - DNA, 22 bp, Homo sapiens
gctgcgtgcaggccgagggctg

SEQ ID NO: 2538 - DNA, 21 bp, Homo sapiens
gggccggtggctgcgtgcagg

SEQ ID NO: 2539 - DNA, 38 bp, Homo sapiens
gagtccgcgttcggcctcctggcgcgggtgggctctcc

SEQ ID NO: 2540 - DNA, 22 bp, Homo sapiens
cggcctcctggcgcgggtgggc

SEQ ID NO: 2541 - DNA, 22 bp, Homo sapiens
tcctggcgcgggtgggctctcc

SEQ ID NO: 2542 - DNA, 23 bp, Homo sapiens
gagtccgcgttcggcctcctggc

SEQ ID NO: 2543 - DNA, 32 bp, Homo sapiens
cgatctcccagctgccggtcccctccaccttc

SEQ ID NO: 2544 - DNA, 22 bp, Homo sapiens
tcccagctgccggtcccctcca

SEQ ID NO: 2545 - DNA, 22 bp, Homo sapiens
ccgcaccacgctgaggtccatc

SEQ ID NO: 2546 - DNA, 23 bp, Homo sapiens
gagccgcaccacgctgaggtcca

SEQ ID NO: 2547 - DNA, 28 bp, Homo sapiens
accaaacatgcctccgcctccagctccg

SEQ ID NO: 2548 - DNA, 22 bp, Homo sapiens
catgcctccgcctccagctccg

SEQ ID NO: 2549 - DNA, 25 bp, Homo sapiens
accattcccaacggtggcctcgctg

SEQ ID NO: 2550 - DNA, 22 bp, Homo sapiens
ccattcccaacggtggcctcgc

SEQ ID NO: 2551 - DNA, 29 bp, Homo sapiens
ccccagcggccaccagcagcagcaaacat

SEQ ID NO: 2552 - DNA, 22 bp, Homo sapiens
cccagcggccaccagcagcagc

SEQ ID NO: 2553 - DNA, 36 bp, Homo sapiens
gcggaaggatgtctccacgcccgtgtcgcagacact

SEQ ID NO: 2554 - DNA, 22 bp, Homo sapiens
tgtctccacgcccgtgtcgcag

SEQ ID NO: 2555 - DNA, 47 bp, Homo sapiens
gttaaatcgagaatgattcaggcgggccggctctctgagcacctttg

SEQ ID NO: 2556 - DNA, 22 bp, Homo sapiens
caggcgggccggctctctgagc

SEQ ID NO: 2557 - DNA, 26 bp, Homo sapiens
aggaaggacaggcggcaggcggaggg

SEQ ID NO: 2558 - DNA, 22 bp, Homo sapiens
ggaaggacaggcggcaggcgga

SEQ ID NO: 2559 - DNA, 49 bp, Homo sapiens
gcagctgggcccgcggcgtgcactacagacgagccattcgccggaattc

SEQ ID NO: 2560 - DNA, 22 bp, Homo sapiens
gacgagccattcgccggaattc

SEQ ID NO: 2561 - DNA, 22 bp, Homo sapiens
cccgcggcgtgcactacagacg

SEQ ID NO: 2562 - DNA, 22 bp, Homo sapiens
gcagctgggcccgcggcgtgca

SEQ ID NO: 2563 - DNA, 26 bp, Homo sapiens
ggatgctgcccgcggagcgcccctcg

SEQ ID NO: 2564 - DNA, 22 bp, Homo sapiens
gctgcccgcggagcgcccctcg

SEQ ID NO: 2565 - DNA, 40 bp, Homo sapiens
tctggaaactgtggatgcagcggtccgggcagagctcagc

SEQ ID NO: 2566 - DNA, 22 bp, Homo sapiens
tgtggatgcagcggtccgggca

SEQ ID NO: 2567 - DNA, 27 bp, Homo sapiens
gggcctgcctgatgggtcccgcactgt

SEQ ID NO: 2568 - DNA, 22 bp, Homo sapiens
gggcctgcctgatgggtcccgc

SEQ ID NO: 2569 - DNA, 25 bp, Homo sapiens
gcctcccagcctggtcccgtgaaat

SEQ ID NO: 2570 - DNA, 22 bp, Homo sapiens
gcctcccagcctggtcccgtga

SEQ ID NO: 2571 - DNA, 31 bp, Homo sapiens
ggaaggccgccgcagctgcatggagacacgc

SEQ ID NO: 2572 - DNA, 22 bp, Homo sapiens
ggccgccgcagctgcatggaga

SEQ ID NO: 2573 - DNA, 32 bp, Homo sapiens
aggcacagcaatgcgtcgaggtggaggccggg

SEQ ID NO: 2574 - DNA, 22 bp, Homo sapiens
atgcgtcgaggtggaggccggg

SEQ ID NO: 2575 - DNA, 22 bp, Homo sapiens
gggcccccagtggagcaggagc

SEQ ID NO: 2576 - DNA, 40 bp, Homo sapiens
ccagaattttagacgcccgcctcctccagccgcctgtccg

SEQ ID NO: 2577 - DNA, 25 bp, Homo sapiens
gacgcccgcctcctccagccgcctg

SEQ ID NO: 2578 - DNA, 31 bp, Homo sapiens
ccgaagggctgggagaaggtgggcaaggcct

SEQ ID NO: 2579 - DNA, 24 bp, Homo sapiens
gggctgggagaaggtgggcaaggc

SEQ ID NO: 2580 - DNA, 35 bp, Homo sapiens
gcagatccaggcactcagggcttcgggctcggacc

SEQ ID NO: 2581 - DNA, 23 bp, Homo sapiens
ggcactcagggcttcgggctcgg

SEQ ID NO: 2582 - DNA, 40 bp, Homo sapiens
gctagatgcaaggctgttcgtcccccctgccgctctgtgg

SEQ ID NO: 2583 - DNA, 22 bp, Homo sapiens
cgtcccccctgccgctctgtgg

SEQ ID NO: 2584 - DNA, 22 bp, Homo sapiens
ggctgttcgtcccccctgccgc

SEQ ID NO: 2585 - DNA, 33 bp, Homo sapiens
ccttcagaaggaggcgggtgagggtcgggtacc

SEQ ID NO: 2586 - DNA, 22 bp, Homo sapiens
aaggaggcgggtgagggtcggg

SEQ ID NO: 2587 - DNA, 30 bp, Homo sapiens
acctgccaggtccccgccagccagctcgta

SEQ ID NO: 2588 - DNA, 22 bp, Homo sapiens
tgccaggtccccgccagccagc

SEQ ID NO: 2589 - DNA, 36 bp, Homo sapiens
ccccacagaaacggcgcagatccccagctccgagca

SEQ ID NO: 2590 - DNA, 22 bp, Homo sapiens
cggcgcagatccccagctccga

SEQ ID NO: 2591 - DNA, 20 bp, Homo sapiens
ccccacagaaacggcgcaga

SEQ ID NO: 2592 - DNA, 38 bp, Homo sapiens
aggtgggcaaggccttcctccgcttccgctgcacctct

SEQ ID NO: 2593 - DNA, 23 bp, Homo sapiens
ggccttcctccgcttccgctgca

SEQ ID NO: 2594 - DNA, 22 bp, Homo sapiens
ggtgggcaaggccttcctccgc

SEQ ID NO: 2595 - DNA, 27 bp, Homo sapiens
cgtagcccccggctgcacccccagagc

SEQ ID NO: 2596 - DNA, 22 bp, Homo sapiens
gcccccggctgcacccccagag

SEQ ID NO: 2597 - DNA, 23 bp, Homo sapiens
gggcccgcgccggactggtaggg

SEQ ID NO: 2598 - DNA, 22 bp, Homo sapiens
ggcccgcgccggactggtaggg

SEQ ID NO: 2599 - DNA, 39 bp, Homo sapiens
ggcttcctccccggagtccctgctgggcaccgtggcggc

SEQ ID NO: 2600 - DNA, 22 bp, Homo sapiens
tccctgctgggcaccgtggcgg

SEQ ID NO: 2601 - DNA, 22 bp, Homo sapiens
tcctccccggagtccctgctgg

SEQ ID NO: 2602 - DNA, 24 bp, Homo sapiens
gctcggctccgcggcttcctcccc

SEQ ID NO: 2603 - DNA, 22 bp, Homo sapiens
tcggctccgcggcttcctcccc

SEQ ID NO: 2604 - DNA, 24 bp, Homo sapiens
gctgcgtgcgccaggccgaacagg

SEQ ID NO: 2605 - DNA, 22 bp, Homo sapiens
gctgcgtgcgccaggccgaaca

SEQ ID NO: 2606 - DNA, 38 bp, Homo sapiens
ccacactcgtctgccccgtgatcaccgccaggtgcagg

SEQ ID NO: 2607 - DNA, 22 bp, Homo sapiens
ctgccccgtgatcaccgccagg

SEQ ID NO: 2608 - DNA, 26 bp, Homo sapiens
gcctgcccgcagcgccagatgcatgg

SEQ ID NO: 2609 - DNA, 22 bp, Homo sapiens
gcccgcagcgccagatgcatgg

SEQ ID NO: 2610 - DNA, 34 bp, Homo sapiens
gcaaaggtgcgagcgttcacgttggcccggagct

SEQ ID NO: 2611 - DNA, 22 bp, Homo sapiens
gcgagcgttcacgttggcccgg

SEQ ID NO: 2612 - DNA, 25 bp, Homo sapiens
gcgtgtggccccggaagctgcttcg

SEQ ID NO: 2613 - DNA, 22 bp, Homo sapiens
gcgtgtggccccggaagctgct

SEQ ID NO: 2614 - DNA, 29 bp, Homo sapiens
gggtgcccgtgcgagagccctcctggtgg

SEQ ID NO: 2615 - DNA, 22 bp, Homo sapiens
gcccgtgcgagagccctcctgg

SEQ ID NO: 2616 - DNA, 36 bp, Homo sapiens
cgcctcgtgccggtccctttcctgcccccaccccgg

SEQ ID NO: 2617 - DNA, 22 bp, Homo sapiens
ccctttcctgcccccaccccgg

SEQ ID NO: 2618 - DNA, 22 bp, Homo sapiens
cgcctcgtgccggtccctttcc

SEQ ID NO: 2619 - DNA, 32 bp, Homo sapiens
gccccgaccgccctcatagtctccctcgctgg

SEQ ID NO: 2620 - DNA, 22 bp, Homo sapiens
ccgccctcatagtctccctcgc

SEQ ID NO: 2621 - DNA, 27 bp, Homo sapiens
gccttgtggtcgccgccgctggtctgg

SEQ ID NO: 2622 - DNA, 22 bp, Homo sapiens
gtggtcgccgccgctggtctgg

SEQ ID NO: 2623 - DNA, 39 bp, Homo sapiens
cttttccctagccccctaatcgccaccaagccctcctgc

SEQ ID NO: 2624 - DNA, 22 bp, Homo sapiens
aatcgccaccaagccctcctgc

SEQ ID NO: 2625 - DNA, 32 bp, Homo sapiens
gcaagccctgctccttacctcccgccgactgc

SEQ ID NO: 2626 - DNA, 22 bp, Homo sapiens
cctgctccttacctcccgccga

SEQ ID NO: 2627 - DNA, 44 bp, Homo sapiens
gaaatgccattctccatcgcccccacctcttcacctcaccattg

SEQ ID NO: 2628 - DNA, 22 bp, Homo sapiens
ccatcgcccccacctcttcacc

SEQ ID NO: 2629 - DNA, 51 bp, Homo sapiens
ttccccaatcttccctccaagccccccactctgcccactgctcccgaaggt

SEQ ID NO: 2630 - DNA, 22 bp, Homo sapiens
agccccccactctgcccactgc

SEQ ID NO: 2631 - DNA, 39 bp, Homo sapiens
ccgccgcggctgaactctcatcttgactcgctgctcctc

SEQ ID NO: 2632 - DNA, 22 bp, Homo sapiens
tcatcttgactcgctgctcctc

SEQ ID NO: 2633 - DNA, 42 bp, Homo sapiens
acggattgttcattcttgagtctgctgctgctgccgccgcgg

SEQ ID NO: 2634 - DNA, 22 bp, Homo sapiens
tctgctgctgctgccgccgcgg

SEQ ID NO: 2635 - DNA, 22 bp, Homo sapiens
gagtctgctgctgctgccgccg

SEQ ID NO: 2636 - DNA, 48 bp, Homo sapiens
cactgaaggctgctgggaaggctggcttggctgctgcgaatcccccga

SEQ ID NO: 2637 - DNA, 22 bp, Homo sapiens
ttggctgctgcgaatcccccga

SEQ ID NO: 2638 - DNA, 22 bp, Homo sapiens
gaaggctgctgggaaggctggc

SEQ ID NO: 2639 - DNA, 29 bp, Homo sapiens
cagctgtgcctgtgcctgtgcctgctgga

SEQ ID NO: 2640 - DNA, 22 bp, Homo sapiens
tgcctgtgcctgtgcctgctgg

SEQ ID NO: 2641 - DNA, 33 bp, Homo sapiens
cactgtgctgctggctggcggagtgctgctgca

SEQ ID NO: 2642 - DNA, 22 bp, Homo sapiens
ctggctggcggagtgctgctgc

SEQ ID NO: 2643 - DNA, 37 bp, Homo sapiens
gcgtcatgggcgtggcagcagaggcggagatggtggc

SEQ ID NO: 2644 - DNA, 22 bp, Homo sapiens
tgggcgtggcagcagaggcgga

SEQ ID NO: 2645 - DNA, 30 bp, Homo sapiens
gggttgctggctgggaggtgagggtgatgc

SEQ ID NO: 2646 - DNA, 22 bp, Homo sapiens
tgctggctgggaggtgagggtg

SEQ ID NO: 2647 - DNA, 36 bp, Homo sapiens
ctggagaattcagggcacttgggctggagagggacg

SEQ ID NO: 2648 - DNA, 22 bp, Homo sapiens
gggcacttgggctggagaggga

SEQ ID NO: 2649 - DNA, 43 bp, Homo sapiens
gatggactcagcagaggtggaggtggcgtgaaggctggctaca

SEQ ID NO: 2650 - DNA, 22 bp, Homo sapiens
tggaggtggcgtgaaggctggc

SEQ ID NO: 2651 - DNA, 36 bp, Homo sapiens
ccttggaggcggtggtggtggtggacgcagccccgc

SEQ ID NO: 2652 - DNA, 22 bp, Homo sapiens
gtggtggtggacgcagccccgc

SEQ ID NO: 2653 - DNA, 22 bp, Homo sapiens
tggaggcggtggtggtggtgga

SEQ ID NO: 2654 - DNA, 28 bp, Homo sapiens
gcgggtcgggcagcgtagggcgggtcac

SEQ ID NO: 2655 - DNA, 22 bp, Homo sapiens
gcgggtcgggcagcgtagggcg

SEQ ID NO: 2656 - DNA, 48 bp, Homo sapiens
gggctgcgggtgcgagaggtgcgggtcgggcagcgtagggcgggtcac

SEQ ID NO: 2657 - DNA, 22 bp, Homo sapiens
gctgcgggtgcgagaggtgcgg

SEQ ID NO: 2658 - DNA, 41 bp, Homo sapiens
cgcagccccgcccccgcccccaccccctccagctgtccggc

SEQ ID NO: 2659 - DNA, 22 bp, Homo sapiens
cgcagccccgcccccgccccca

SEQ ID NO: 2660 - DNA, 22 bp, Homo sapiens
cgcccccaccccctccagctgt

SEQ ID NO: 2661 - DNA, 30 bp, Homo sapiens
gaagtgaaccatgctgcccgccccgccagg

SEQ ID NO: 2662 - DNA, 22 bp, Homo sapiens
aaccatgctgcccgccccgcca

SEQ ID NO: 2663 - DNA, 38 bp, Homo sapiens
ccgccgcgggctgctgctgctgctcctgctgctgccag

SEQ ID NO: 2664 - DNA, 23 bp, Homo sapiens
gctgctgctcctgctgctgccag

SEQ ID NO: 2665 - DNA, 23 bp, Homo sapiens
ccgccgcgggctgctgctgctgc

SEQ ID NO: 2666 - DNA, 40 bp, Homo sapiens
cgaagaggttgctctgcagcggcggcgtgggcaggcaggc

SEQ ID NO: 2667 - DNA, 22 bp, Homo sapiens
gcggcggcgtgggcaggcaggc

SEQ ID NO: 2668 - DNA, 23 bp, Homo sapiens
tgctctgcagcggcggcgtgggc

SEQ ID NO: 2669 - DNA, 22 bp, Homo sapiens
gccgccaccgccgcctcccccg

SEQ ID NO: 2670 - DNA, 22 bp, Homo sapiens
gccgccaccgccgcctcccccg

SEQ ID NO: 2671 - DNA, 26 bp, Homo sapiens
ggagccgcccaggagcccgccgcccg

SEQ ID NO: 2672 - DNA, 22 bp, Homo sapiens
agccgcccaggagcccgccgcc

SEQ ID NO: 2673 - DNA, 22 bp, Homo sapiens
cgccgccgccgccaccagcccg

SEQ ID NO: 2674 - DNA, 21 bp, Homo sapiens
gccgccgccgccaccagcccg

SEQ ID NO: 2675 - DNA, 29 bp, Homo sapiens
gccgacgccgccgccgctgccgctgccgc

SEQ ID NO: 2676 - DNA, 20 bp, Homo sapiens
acgccgccgccgctgccgct

SEQ ID NO: 2677 - DNA, 33 bp, Homo sapiens
gccgccgccgccgatgccgctgccacctgcccg

SEQ ID NO: 2678 - DNA, 22 bp, Homo sapiens
cgatgccgctgccacctgcccg

SEQ ID NO: 2679 - DNA, 22 bp, Homo sapiens
gccgccgccgatgccgctgcca

SEQ ID NO: 2680 - DNA, 23 bp, Homo sapiens
cgcttcttctcgccgccgttgaa

SEQ ID NO: 2681 - DNA, 22 bp, Homo sapiens
cgcttcttctcgccgccgttga

SEQ ID NO: 2682 - DNA, 47 bp, Homo sapiens
cctcagctccccattctgtcccgcccgacacctcccagccccctcag

SEQ ID NO: 2683 - DNA, 22 bp, Homo sapiens
cccgcccgacacctcccagccc

SEQ ID NO: 2684 - DNA, 22 bp, Homo sapiens
gctccccattctgtcccgcccg

SEQ ID NO: 2685 - DNA, 56 bp, Homo sapiens
ggtctccgctttccttccccccactccccactcccccgaatgctcccccccttctc

SEQ ID NO: 2686 - DNA, 22 bp, Homo sapiens
tcccccgaatgctccccccctt

SEQ ID NO: 2687 - DNA, 21 bp, Homo sapiens
ccccactccccactcccccga

SEQ ID NO: 2688 - DNA, 22 bp, Homo sapiens
ccgctttccttccccccactcc

SEQ ID NO: 2689 - DNA, 50 bp, Homo sapiens
ccattttcctacccttcccgcgtctccccccacccaaaccccagaaccat

SEQ ID NO: 2690 - DNA, 24 bp, Homo sapiens
ttcccgcgtctccccccacccaaa

SEQ ID NO: 2691 - DNA, 22 bp, Homo sapiens
tccccccacccaaaccccagaa

SEQ ID NO: 2692 - DNA, 37 bp, Homo sapiens
ttccacctaagcaagcagccagcctccccctgaccct

SEQ ID NO: 2693 - DNA, 22 bp, Homo sapiens
aagcaagcagccagcctccccc

SEQ ID NO: 2694 - DNA, 31 bp, Homo sapiens
ggtcccgcttctccgacagctctagccccgc

SEQ ID NO: 2695 - DNA, 22 bp, Homo sapiens
tctccgacagctctagccccgc

SEQ ID NO: 2696 - DNA, 24 bp, Homo sapiens
ctgctgctgccaggcgctccctct

SEQ ID NO: 2697 - DNA, 22 bp, Homo sapiens
tgctgctgccaggcgctccctc

SEQ ID NO: 2698 - DNA, 22 bp, Homo sapiens
cgatgtccacggccgccagcgc

SEQ ID NO: 2699 - DNA, 39 bp, Homo sapiens
ctgttcatcgtgtggtacgtggcgtccggcttgaaagga

SEQ ID NO: 2700 - DNA, 22 bp, Homo sapiens
cgtggcgtccggcttgaaagga

SEQ ID NO: 2701 - DNA, 22 bp, Homo sapiens
cgtgtggtacgtggcgtccggc

SEQ ID NO: 2702 - DNA, 29 bp, Homo sapiens
gccgggttcgagcgcctggtggtggtggt

SEQ ID NO: 2703 - DNA, 22 bp, Homo sapiens
gccgggttcgagcgcctggtgg

SEQ ID NO: 2704 - DNA, 25 bp, Homo sapiens
gccggccatgagcgcgagcgacggc

SEQ ID NO: 2705 - DNA, 22 bp, Homo sapiens
cggccatgagcgcgagcgacgg

SEQ ID NO: 2706 - DNA, 24 bp, Homo sapiens
cccggacggcatgttcatggcggc

SEQ ID NO: 2707 - DNA, 22 bp, Homo sapiens
cccggacggcatgttcatggcg

SEQ ID NO: 2708 - DNA, 32 bp, Homo sapiens
tccgagtcgcagatggacgccaggcccgctgc

SEQ ID NO: 2709 - DNA, 22 bp, Homo sapiens
cgcagatggacgccaggcccgc

SEQ ID NO: 2710 - DNA, 32 bp, Homo sapiens
cccacgtcggcctgcgtcacgcccagcttgat

SEQ ID NO: 2711 - DNA, 22 bp, Homo sapiens
cccacgtcggcctgcgtcacgc

SEQ ID NO: 2712 - DNA, 25 bp, Homo sapiens
cgaggctgaatggcaaagtaggctt

SEQ ID NO: 2713 - DNA, 25 bp, Homo sapiens
ccgaggctgaatggcaaagtaggct

SEQ ID NO: 2714 - DNA, 27 bp, Homo sapiens
gccagcgcggagcccacatctgcctgg

SEQ ID NO: 2715 - DNA, 23 bp, Homo sapiens
gccagcgcggagcccacatctgc

SEQ ID NO: 2716 - DNA, 27 bp, Homo sapiens
gggatcttgaggttggccagcgcggag

SEQ ID NO: 2717 - DNA, 22 bp, Homo sapiens
ttgaggttggccagcgcggagc

SEQ ID NO: 2718 - DNA, 35 bp, Homo sapiens
tgagcttctcgcggtgggacttctcggcctcctcg

SEQ ID NO: 2719 - DNA, 22 bp, Homo sapiens
ctcgcggtgggacttctcggcc

SEQ ID NO: 2720 - DNA, 19 bp, Homo sapiens
tgggacttctcggcctcct

SEQ ID NO: 2721 - DNA, 31 bp, Homo sapiens
gcccaatcgccgccgccgcctcctcccgtgg

SEQ ID NO: 2722 - DNA, 22 bp, Homo sapiens
gcccaatcgccgccgccgcctc

SEQ ID NO: 2723 - DNA, 30 bp, Homo sapiens
ggtgccgccgcctcctgccttgccgtgttc

SEQ ID NO: 2724 - DNA, 22 bp, Homo sapiens
gccgccgcctcctgccttgccg

SEQ ID NO: 2725 - DNA, 32 bp, Homo sapiens
cgtggaaacctccgccgccgccgccgtcgtcg

SEQ ID NO: 2726 - DNA, 22 bp, Homo sapiens
tggaaacctccgccgccgccgc

SEQ ID NO: 2727 - DNA, 29 bp, Homo sapiens
cgccgccaccgcccgccgccagcatcccg

SEQ ID NO: 2728 - DNA, 22 bp, Homo sapiens
cgccaccgcccgccgccagcat

SEQ ID NO: 2729 - DNA, 28 bp, Homo sapiens
cccagatgcggcggcggcgacggctcca

SEQ ID NO: 2730 - DNA, 22 bp, Homo sapiens
tgcggcggcggcgacggctcca

SEQ ID NO: 2731 - DNA, 26 bp, Homo sapiens
catgtccgtgtgcgtgtccgtgggcg

SEQ ID NO: 2732 - DNA, 22 bp, Homo sapiens
tccgtgtgcgtgtccgtgggcg

SEQ ID NO: 2733 - DNA, 28 bp, Homo sapiens
cgcccaccgatgagccgccgccgcccgc

SEQ ID NO: 2734 - DNA, 22 bp, Homo sapiens
ccgatgagccgccgccgcccgc

SEQ ID NO: 2735 - DNA, 30 bp, Homo sapiens
gcttgatgcgccgctgcttgaactgcttgg

SEQ ID NO: 2736 - DNA, 22 bp, Homo sapiens
cgccgctgcttgaactgcttgg

SEQ ID NO: 2737 - DNA, 28 bp, Homo sapiens
gggcagagagcaggcggcgggcaggatg

SEQ ID NO: 2738 - DNA, 22 bp, Homo sapiens
gggcagagagcaggcggcgggc

SEQ ID NO: 2739 - DNA, 40 bp, Homo sapiens
gggcgagaaggcgaaatccgaagccaggtgtcccgccatg

SEQ ID NO: 2740 - DNA, 22 bp, Homo sapiens
tccgaagccaggtgtcccgcca

SEQ ID NO: 2741 - DNA, 22 bp, Homo sapiens
gggcgagaaggcgaaatccgaa

SEQ ID NO: 2742 - DNA, 40 bp, Homo sapiens
gcccacagtacgccatccccccacagaactcatacggcgg

SEQ ID NO: 2743 - DNA, 22 bp, Homo sapiens
cgccatccccccacagaactca

SEQ ID NO: 2744 - DNA, 29 bp, Homo sapiens
gagttgctctccaccccgactcctgcttc

SEQ ID NO: 2745 - DNA, 22 bp, Homo sapiens
tgctctccaccccgactcctgc

SEQ ID NO: 2746 - DNA, 30 bp, Homo sapiens
cctcaaagcggcagatggtcgtttggctga

SEQ ID NO: 2747 - DNA, 22 bp, Homo sapiens
aagcggcagatggtcgtttggc

SEQ ID NO: 2748 - DNA, 25 bp, Homo sapiens
caagctgctgggcgatgtggctgat

SEQ ID NO: 2749 - DNA, 22 bp, Homo sapiens
gctgctgggcgatgtggctgat

SEQ ID NO: 2750 - DNA, 46 bp, Homo sapiens
ggttttctttccctagctcctcccctccccctgtcccccattccta

SEQ ID NO: 2751 - DNA, 20 bp, Homo sapiens
tcccctccccctgtccccca

SEQ ID NO: 2752 - DNA, 33 bp, Homo sapiens
gttgccccaaactcccctgcccccaccctttgt

SEQ ID NO: 2753 - DNA, 22 bp, Homo sapiens
tgccccaaactcccctgccccc

SEQ ID NO: 2754 - DNA, 24 bp, Homo sapiens
cccaacccccggcccgattcctgg

SEQ ID NO: 2755 - DNA, 22 bp, Homo sapiens
caacccccggcccgattcctgg

SEQ ID NO: 2756 - DNA, 45 bp, Homo sapiens
ggctgaacaggttcccaaatagaacccccaggatgagccccacat

SEQ ID NO: 2757 - DNA, 22 bp, Homo sapiens
agaacccccaggatgagcccca

SEQ ID NO: 2758 - DNA, 33 bp, Homo sapiens
gatactggttcgctttctctttcgggcctgcat

SEQ ID NO: 2759 - DNA, 22 bp, Homo sapiens
tggttcgctttctctttcgggc

SEQ ID NO: 2760 - DNA, 44 bp, Homo sapiens
ggttctctttccctagctcctcccctcccctgttccccattcct

SEQ ID NO: 2761 - DNA, 22 bp, Homo sapiens
tcctcccctcccctgttcccca

SEQ ID NO: 2762 - DNA, 48 bp, Homo sapiens
aagctgaagtcccctttaaccaatacccatcccacctcccacactcat

SEQ ID NO: 2763 - DNA, 22 bp, Homo sapiens
ccaatacccatcccacctccca

SEQ ID NO: 2764 - DNA, 22 bp, Homo sapiens
cccatcccacctcccacactca

SEQ ID NO: 2765 - DNA, 49 bp, Homo sapiens
gtgcatcatcttctcaggcttcttccgcgcagatccttcccacttcttt

SEQ ID NO: 2766 - DNA, 22 bp, Homo sapiens
tcttccgcgcagatccttccca

SEQ ID NO: 2767 - DNA, 23 bp, Homo sapiens
ggccaaaggctgttccacattca

SEQ ID NO: 2768 - DNA, 26 bp, Homo sapiens
tcattctgcaacttgatcccccctca

SEQ ID NO: 2769 - DNA, 22 bp, Homo sapiens
tctgcaacttgatcccccctca

SEQ ID NO: 2770 - DNA, 53 bp, Homo sapiens
gggctgcgcgccacggcccccgacttctttctccctcccaggcgcgctacccg

SEQ ID NO: 2771 - DNA, 22 bp, Homo sapiens
tccctcccaggcgcgctacccg

SEQ ID NO: 2772 - DNA, 22 bp, Homo sapiens
cggcccccgacttctttctccc

SEQ ID NO: 2773 - DNA, 22 bp, Homo sapiens
tgcgcgccacggcccccgactt

SEQ ID NO: 2774 - DNA, 23 bp, Homo sapiens
gcgaccaccgccgccccctcagc

SEQ ID NO: 2775 - DNA, 22 bp, Homo sapiens
cgaccaccgccgccccctcagc

SEQ ID NO: 2776 - DNA, 28 bp, Homo sapiens
ccaaccgtgggaataatgcttttgcggc

SEQ ID NO: 2777 - DNA, 23 bp, Homo sapiens
cgtgggaataatgcttttgcggc

SEQ ID NO: 2778 - DNA, 39 bp, Homo sapiens
tataaatggagtgctgctgggaaatgcggcgtggtgagc

SEQ ID NO: 2779 - DNA, 22 bp, Homo sapiens
gctgctgggaaatgcggcgtgg

SEQ ID NO: 2780 - DNA, 37 bp, Homo sapiens
cgcaaccttggctcaccacaacctccgcttcctgggt

SEQ ID NO: 2781 - DNA, 22 bp, Homo sapiens
ggctcaccacaacctccgcttc

SEQ ID NO: 2782 - DNA, 31 bp, Homo sapiens
aatgcgtgatttgcgggctggctccaaggag

SEQ ID NO: 2783 - DNA, 22 bp, Homo sapiens
gcgtgatttgcgggctggctcc

SEQ ID NO: 2784 - DNA, 26 bp, Homo sapiens
ctagagaaaaagcaggaggcgggcgc

SEQ ID NO: 2785 - DNA, 22 bp, Homo sapiens
agaaaaagcaggaggcgggcgc

SEQ ID NO: 2786 - DNA, 34 bp, Homo sapiens
gcgaagccctgcccaccgccccccgagccagccg

SEQ ID NO: 2787 - DNA, 22 bp, Homo sapiens
tgcccaccgccccccgagccag

SEQ ID NO: 2788 - DNA, 62 bp, Homo sapiens
agccgacctcgactcatgactgcagccccgaacccccacccccacgccgcctaacccgccag

SEQ ID NO: 2789 - DNA, 22 bp, Homo sapiens
cccacgccgcctaacccgccag

SEQ ID NO: 2790 - DNA, 22 bp, Homo sapiens
ccgaacccccacccccacgccg

SEQ ID NO: 2791 - DNA, 22 bp, Homo sapiens
tgactgcagccccgaaccccca

SEQ ID NO: 2792 - DNA, 28 bp, Homo sapiens
ccgaggcgggatggcagggcgggcaggg

SEQ ID NO: 2793 - DNA, 22 bp, Homo sapiens
gggatggcagggcgggcagggc

SEQ ID NO: 2794 - DNA, 21 bp, Homo sapiens
ccgaggcgggatggcagggcg

SEQ ID NO: 2795 - DNA, 39 bp, Homo sapiens
ctggcccaggtgcggtcccactttcccaccccgaggcgg

SEQ ID NO: 2796 - DNA, 22 bp, Homo sapiens
cccactttcccaccccgaggcg

SEQ ID NO: 2797 - DNA, 32 bp, Homo sapiens
ccttcccgggtggctagagcgcgaaagaaaga

SEQ ID NO: 2798 - DNA, 22 bp, Homo sapiens
ttcccgggtggctagagcgcga

SEQ ID NO: 2799 - DNA, 47 bp, Homo sapiens
agcagtttcaaactcaccgcgctaaagggccccggattcaccaatcg

SEQ ID NO: 2800 - DNA, 22 bp, Homo sapiens
ctcaccgcgctaaagggccccg

SEQ ID NO: 2801 - DNA, 27 bp, Homo sapiens
cggcggcgcagcggcagctacaacaag

SEQ ID NO: 2802 - DNA, 22 bp, Homo sapiens
ggcggcgcagcggcagctacaa

SEQ ID NO: 2803 - DNA, 32 bp, Homo sapiens
ccagccgggccccgcgcagatccctgacctcc

SEQ ID NO: 2804 - DNA, 22 bp, Homo sapiens
cagccgggccccgcgcagatcc

SEQ ID NO: 2805 - DNA, 22 bp, Homo sapiens
ggccccgcgcagatccctgacc

SEQ ID NO: 2806 - DNA, 37 bp, Homo sapiens
cccactgccccacccccagccccagcgattttcccga

SEQ ID NO: 2807 - DNA, 22 bp, Homo sapiens
cccagccccagcgattttcccg

SEQ ID NO: 2808 - DNA, 25 bp, Homo sapiens
ggcccgccccttccgcttcacgacg

SEQ ID NO: 2809 - DNA, 22 bp, Homo sapiens
ccgccccttccgcttcacgacg

SEQ ID NO: 2810 - DNA, 26 bp, Homo sapiens
cgtgagccaccgcccccagcagcact

SEQ ID NO: 2811 - DNA, 22 bp, Homo sapiens
tgagccaccgcccccagcagca

SEQ ID NO: 2812 - DNA, 27 bp, Homo sapiens
cgtgagcccccaagccccgcctaccta

SEQ ID NO: 2813 - DNA, 22 bp, Homo sapiens
cgtgagcccccaagccccgcct

SEQ ID NO: 2814 - DNA, 28 bp, Homo sapiens
ggtgatccacccgcctcagcctcccgaa

SEQ ID NO: 2815 - DNA, 22 bp, Homo sapiens
tccacccgcctcagcctcccga

SEQ ID NO: 2816 - DNA, 29 bp, Homo sapiens
cggcgtgggtctcgggcgtctgtggctcc

SEQ ID NO: 2817 - DNA, 22 bp, Homo sapiens
cggcgtgggtctcgggcgtctg

SEQ ID NO: 2818 - DNA, 24 bp, Homo sapiens
cgctgccctcgcccgcttgctccg

SEQ ID NO: 2819 - DNA, 22 bp, Homo sapiens
ctgccctcgcccgcttgctccg

SEQ ID NO: 2820 - DNA, 47 bp, Homo sapiens
gtctgtgtcgccctcgtccgtgtctgcctcccgcttccccgcctcgc

SEQ ID NO: 2821 - DNA, 22 bp, Homo sapiens
tgcctcccgcttccccgcctcg

SEQ ID NO: 2822 - DNA, 33 bp, Homo sapiens
ggaacgcccaaccctccccacgcaccgatctgt

SEQ ID NO: 2823 - DNA, 22 bp, Homo sapiens
gcccaaccctccccacgcaccg

SEQ ID NO: 2824 - DNA, 57 bp, Homo sapiens
ggaagcaccccccgccgcctccgctcccctacaccccgtccccctcaccgagcgtgg

SEQ ID NO: 2825 - DNA, 22 bp, Homo sapiens
cccgtccccctcaccgagcgtg

SEQ ID NO: 2826 - DNA, 22 bp, Homo sapiens
gaagcaccccccgccgcctccg

SEQ ID NO: 2827 - DNA, 33 bp, Homo sapiens
gcagcgccctgagcctgagtccccgcgtgtccg

SEQ ID NO: 2828 - DNA, 22 bp, Homo sapiens
cgccctgagcctgagtccccgc

SEQ ID NO: 2829 - DNA, 25 bp, Homo sapiens
gggatggcggaggcggaaggacggg

SEQ ID NO: 2830 - DNA, 22 bp, Homo sapiens
atggcggaggcggaaggacggg

SEQ ID NO: 2831 - DNA, 40 bp, Homo sapiens
gaccccctgcgtccgccccggcccctcccccaccttgctg

SEQ ID NO: 2832 - DNA, 22 bp, Homo sapiens
cggcccctcccccaccttgctg

SEQ ID NO: 2833 - DNA, 22 bp, Homo sapiens
gaccccctgcgtccgccccggc

SEQ ID NO: 2834 - DNA, 32 bp, Homo sapiens
cgcccccgggaagccttgcacgccgcgccccg

SEQ ID NO: 2835 - DNA, 22 bp, Homo sapiens
aagccttgcacgccgcgccccg

SEQ ID NO: 2836 - DNA, 22 bp, Homo sapiens
cgcccccgggaagccttgcacg

SEQ ID NO: 2837 - DNA, 34 bp, Homo sapiens
gtgtgagccaccgtgccccgccagccatctgtga

SEQ ID NO: 2838 - DNA, 22 bp, Homo sapiens
agccaccgtgccccgccagcca

SEQ ID NO: 2839 - DNA, 22 bp, Homo sapiens
gcccccgcctccgcagccctgg

SEQ ID NO: 2840 - DNA, 26 bp, Homo sapiens
cacaggacagtgggcggtgggtaggc

SEQ ID NO: 2841 - DNA, 24 bp, Homo sapiens
caggacagtgggcggtgggtaggc

SEQ ID NO: 2842 - DNA, 25 bp, Homo sapiens
ctgggaccgaaggatggctgggtgg

SEQ ID NO: 2843 - DNA, 22 bp, Homo sapiens
ggaccgaaggatggctgggtgg

SEQ ID NO: 2844 - DNA, 34 bp, Homo sapiens
ttcctgcacccccttcccaaccctccccgtgcgg

SEQ ID NO: 2845 - DNA, 22 bp, Homo sapiens
ccttcccaaccctccccgtgcg

SEQ ID NO: 2846 - DNA, 34 bp, Homo sapiens
ccagagctggcatcgcacccggaagccgcatggt

SEQ ID NO: 2847 - DNA, 22 bp, Homo sapiens
tcgcacccggaagccgcatggt

SEQ ID NO: 2848 - DNA, 22 bp, Homo sapiens
agctggcatcgcacccggaagc

SEQ ID NO: 2849 - DNA, 26 bp, Homo sapiens
ctctcccaggagccgcacgtagccgc

SEQ ID NO: 2850 - DNA, 22 bp, Homo sapiens
cccaggagccgcacgtagccgc

SEQ ID NO: 2851 - DNA, 22 bp, Homo sapiens
gcatgccccggccacgacagcg

SEQ ID NO: 2852 - DNA, 28 bp, Homo sapiens
cgggcggcgcttgtcggagtggtgctgc

SEQ ID NO: 2853 - DNA, 22 bp, Homo sapiens
cgggcggcgcttgtcggagtgg

SEQ ID NO: 2854 - DNA, 45 bp, Homo sapiens
cgatgacctcctgcgtgtcctggcccacagcgttgcgcagcgtgc

SEQ ID NO: 2855 - DNA, 22 bp, Homo sapiens
cccacagcgttgcgcagcgtgc

SEQ ID NO: 2856 - DNA, 22 bp, Homo sapiens
ctgcgtgtcctggcccacagcg

SEQ ID NO: 2857 - DNA, 36 bp, Homo sapiens
ctcatagatctcgtcggaggcatgggcaggctgggc

SEQ ID NO: 2858 - DNA, 22 bp, Homo sapiens
cggaggcatgggcaggctgggc

SEQ ID NO: 2859 - DNA, 26 bp, Homo sapiens
ccgaggcgcagggcaccccgaatccg

SEQ ID NO: 2860 - DNA, 22 bp, Homo sapiens
ggcgcagggcaccccgaatccg

SEQ ID NO: 2861 - DNA, 34 bp, Homo sapiens
ccagaccagctcgggccagggaacgcagggactg

SEQ ID NO: 2862 - DNA, 22 bp, Homo sapiens
ccagctcgggccagggaacgca

SEQ ID NO: 2863 - DNA, 31 bp, Homo sapiens
gggagcggcgggagcaggagcaggaacagca

SEQ ID NO: 2864 - DNA, 22 bp, Homo sapiens
cgggagcaggagcaggaacagc

SEQ ID NO: 2865 - DNA, 22 bp, Homo sapiens
gggagcggcgggagcaggagca

SEQ ID NO: 2866 - DNA, 41 bp, Homo sapiens
cttgacaatgttaaagcccacctcgccgccaaatgtgctcg

SEQ ID NO: 2867 - DNA, 22 bp, Homo sapiens
cccacctcgccgccaaatgtgc

SEQ ID NO: 2868 - DNA, 26 bp, Homo sapiens
gagcaagagactccggctcatggcgc

SEQ ID NO: 2869 - DNA, 22 bp, Homo sapiens
aagagactccggctcatggcgc

SEQ ID NO: 2870 - DNA, 23 bp, Homo sapiens
gggctgggccgcagtgaatctcg

SEQ ID NO: 2871 - DNA, 22 bp, Homo sapiens
ggctgggccgcagtgaattccg

SEQ ID NO: 2872 - DNA, 30 bp, Homo sapiens
cctgagcaggaagcggcgggccaggagctg

SEQ ID NO: 2873 - DNA, 22 bp, Homo sapiens
gagcaggaagcggcgggccagg

SEQ ID NO: 2874 - DNA, 48 bp, Homo sapiens
gatgtggtggtccatgttcctgcccccaccgatccggccagcaatctg

SEQ ID NO: 2875 - DNA, 22 bp, Homo sapiens
cccccaccgatccggccagcaa

SEQ ID NO: 2876 - DNA, 22 bp, Homo sapiens
gttcctgcccccaccgatccgg

SEQ ID NO: 2877 - DNA, 26 bp, Homo sapiens
ggtcgctccacagcaggcccatcatc

SEQ ID NO: 2878 - DNA, 22 bp, Homo sapiens
tcgctccacagcaggcccatca

SEQ ID NO: 2879 - DNA, 40 bp, Homo sapiens
gcctgagtagaccgagccgaagccgccgctgcccagtagc

SEQ ID NO: 2880 - DNA, 22 bp, Homo sapiens
ccgagccgaagccgccgctgcc

SEQ ID NO: 2881 - DNA, 23 bp, Homo sapiens
gtagaccgagccgaagccgccgc

SEQ ID NO: 2882 - DNA, 32 bp, Homo sapiens
ggttctgacccacccccaccccccacccccgg

SEQ ID NO: 2883 - DNA, 22 bp, Homo sapiens
tctgacccacccccacccccca

SEQ ID NO: 2884 - DNA, 41 bp, Homo sapiens
cctgtttcccccctacctgacccatcgcggcattcagcaga

SEQ ID NO: 2885 - DNA, 22 bp, Homo sapiens
cccctacctgacccatcgcggc

SEQ ID NO: 2886 - DNA, 22 bp, Homo sapiens
tgacccatcgcggcattcagca

SEQ ID NO: 2887 - DNA, 45 bp, Homo sapiens
acaaacagagcaagcgtcgcagccctcccccaaaaggtccccaag

SEQ ID NO: 2888 - DNA, 22 bp, Homo sapiens
gccctcccccaaaaggtcccca

SEQ ID NO: 2889 - DNA, 22 bp, Homo sapiens
gcaagcgtcgcagccctccccc

SEQ ID NO: 2890 - DNA, 23 bp, Homo sapiens
tcccaacctccaggatgcggcgc

SEQ ID NO: 2891 - DNA, 23 bp, Homo sapiens
cgcgggcgcgcaggtgggcaagc

SEQ ID NO: 2892 - DNA, 25 bp, Homo sapiens
gcaggtcgttgcaggcgcgggcgcg

SEQ ID NO: 2893 - DNA, 22 bp, Homo sapiens
ggtcgttgcaggcgcgggcgcg

SEQ ID NO: 2894 - DNA, 33 bp, Homo sapiens
gctccttctccttgcccggcgccagcttggtgg

SEQ ID NO: 2895 - DNA, 22 bp, Homo sapiens
tccttgcccggcgccagcttgg

SEQ ID NO: 2896 - DNA, 22 bp, Homo sapiens
tccttctccttgcccggcgcca

SEQ ID NO: 2897 - DNA, 42 bp, Homo sapiens
tcgaagagatcttgcaccggctcgggcctctccaggatcagg

SEQ ID NO: 2898 - DNA, 22 bp, Homo sapiens
tgcaccggctcgggcctctcca

SEQ ID NO: 2899 - DNA, 50 bp, Homo sapiens
ggtggagcaccccgcagttgtggcagtgccgcacggcctccagcacctgc

SEQ ID NO: 2900 - DNA, 23 bp, Homo sapiens
tgccgcacggcctccagcacctg

SEQ ID NO: 2901 - DNA, 23 bp, Homo sapiens
ccccgcagttgtggcagtgccgc

SEQ ID NO: 2902 - DNA, 30 bp, Homo sapiens
gagcttgagctcgccgcgattgaggtcgat

SEQ ID NO: 2903 - DNA, 23 bp, Homo sapiens
tgagctcgccgcgattgaggtcg

SEQ ID NO: 2904 - DNA, 22 bp, Homo sapiens
cgatgagcttgagctcgccgcg

SEQ ID NO: 2905 - DNA, 40 bp, Homo sapiens
tgtagacggtgtccttgagcagcgcccccgacccgaagtc

SEQ ID NO: 2906 - DNA, 22 bp, Homo sapiens
ttgagcagcgcccccgacccga

SEQ ID NO: 2907 - DNA, 41 bp, Homo sapiens
gctgctatttgctgggccccggcgacaggctgtggaggtgg

SEQ ID NO: 2908 - DNA, 22 bp, Homo sapiens
ccccggcgacaggctgtggagg

SEQ ID NO: 2909 - DNA, 22 bp, Homo sapiens
tttgctgggccccggcgacagg

SEQ ID NO: 2910 - DNA, 26 bp, Homo sapiens
gtccccccccaaccacctcttgctcc

SEQ ID NO: 2911 - DNA, 23 bp, Homo sapiens
cccccccaaccacctcttgctcc

SEQ ID NO: 2912 - DNA, 47 bp, Homo sapiens
cgccgtggagtcgttgcccgggaaaacgtcagccatggtcccccccc

SEQ ID NO: 2913 - DNA, 22 bp, Homo sapiens
acgtcagccatggtcccccccc

SEQ ID NO: 2914 - DNA, 22 bp, Homo sapiens
gcccgggaaaacgtcagccatg

SEQ ID NO: 2915 - DNA, 24 bp, Homo sapiens
cgtggagtcgttgcccgggaaaac

SEQ ID NO: 2916 - DNA, 35 bp, Homo sapiens
cctttgcgggcgaagcggttggccacgtcctgaga

SEQ ID NO: 2917 - DNA, 22 bp, Homo sapiens
gcgaagcggttggccacgtcct

SEQ ID NO: 2918 - DNA, 22 bp, Homo sapiens
cctttgcgggcgaagcggttgg

SEQ ID NO: 2919 - DNA, 30 bp, Homo sapiens
catccactggccggcatcttcatcagctcc

SEQ ID NO: 2920 - DNA, 22 bp, Homo sapiens
ggccggcatcttcatcagctcc

SEQ ID NO: 2921 - DNA, 25 bp, Homo sapiens
catcaaatggaggctgcccggcaag

SEQ ID NO: 2922 - DNA, 22 bp, Homo sapiens
tcaaatggaggctgcccggcaa

SEQ ID NO: 2923 - DNA, 30 bp, Homo sapiens
gcgcacggtgctctcctcgccctcgctcgg

SEQ ID NO: 2924 - DNA, 22 bp, Homo sapiens
tgctctcctcgccctcgctcgg

SEQ ID NO: 2925 - DNA, 23 bp, Homo sapiens
ggagccggagcccgagaggtgcc

SEQ ID NO: 2926 - DNA, 30 bp, Homo sapiens
cgcagccgggtcagccatcttgcgcgcggg

SEQ ID NO: 2927 - DNA, 22 bp, Homo sapiens
cgggtcagccatcttgcgcgcg

SEQ ID NO: 2928 - DNA, 36 bp, Homo sapiens
gggagcgggcaggtgtgggtggagggcagggctagc

SEQ ID NO: 2929 - DNA, 22 bp, Homo sapiens
ggtgtgggtggagggcagggct

SEQ ID NO: 2930 - DNA, 22 bp, Homo sapiens
gggagcgggcaggtgtgggtgg

SEQ ID NO: 2931 - DNA, 23 bp, Homo sapiens
cactcaggatacatggtcgcttt

SEQ ID NO: 2932 - DNA, 23 bp, Homo sapiens
cactcaggatacatggtcgcttt

SEQ ID NO: 2933 - DNA, 40 bp, Homo sapiens
actcagccttgccattgttcttcttgcagcgctcggccag

SEQ ID NO: 2934 - DNA, 22 bp, Homo sapiens
ttcttcttgcagcgctcggcca

SEQ ID NO: 2935 - DNA, 37 bp, Homo sapiens
cctgtttgatggctccgcggcggttcatcgttgggaa

SEQ ID NO: 2936 - DNA, 22 bp, Homo sapiens
tccgcggcggttcatcgttggg

SEQ ID NO: 2937 - DNA, 22 bp, Homo sapiens
cctgtttgatggctccgcggcg

SEQ ID NO: 2938 - DNA, 23 bp, Homo sapiens
gccgcggtgccagtgcatctgcc

SEQ ID NO: 2939 - DNA, 22 bp, Homo sapiens
gccgcggtgccagtgcatctgc

SEQ ID NO: 2940 - DNA, 31 bp, Homo sapiens
ccttgaagcggtgcggcatgtcgatgttgaa

SEQ ID NO: 2941 - DNA, 22 bp, Homo sapiens
gcggtgcggcatgtcgatgttg

SEQ ID NO: 2942 - DNA, 40 bp, Homo sapiens
gcttcaccagtccccagagcaggctgccgcagtggtcaca

SEQ ID NO: 2943 - DNA, 22 bp, Homo sapiens
tccccagagcaggctgccgcag

SEQ ID NO: 2944 - DNA, 27 bp, Homo sapiens
caccttcccgaagctgcctttgcccag

SEQ ID NO: 2945 - DNA, 22 bp, Homo sapiens
tcccgaagctgcctttgcccag

SEQ ID NO: 2946 - DNA, 26 bp, Homo sapiens
cagaaggtgctggcccggctctcccc

SEQ ID NO: 2947 - DNA, 22 bp, Homo sapiens
aggtgctggcccggctctcccc

SEQ ID NO: 2948 - DNA, 22 bp, Homo sapiens
ccgtttggccgatgcgcgagtc

SEQ ID NO: 2949 - DNA, 29 bp, Homo sapiens
ccaggccgggctgttggtcttctgcttgg

SEQ ID NO: 2950 - DNA, 22 bp, Homo sapiens
ggccgggctgttggtcttctgc

SEQ ID NO: 2951 - DNA, 22 bp, Homo sapiens
gaactcgtcgtgccaggccggg

SEQ ID NO: 2952 - DNA, 32 bp, Homo sapiens
cagtcctcgaagtggcggctcccgttctgcag

SEQ ID NO: 2953 - DNA, 22 bp, Homo sapiens
cctcgaagtggcggctcccgtt

SEQ ID NO: 2954 - DNA, 30 bp, Homo sapiens
cgcttcctcggccgcatgcgttccctgaac

SEQ ID NO: 2955 - DNA, 22 bp, Homo sapiens
tcctcggccgcatgcgttccct

SEQ ID NO: 2956 - DNA, 33 bp, Homo sapiens
gctcgtggcaccgcttgtggaccacgcaggtgc

SEQ ID NO: 2957 - DNA, 22 bp, Homo sapiens
ggcaccgcttgtggaccacgca

SEQ ID NO: 2958 - DNA, 41 bp, Homo sapiens
gggcatgttgacgctgaaccgctgggagcccacctggtcgg

SEQ ID NO: 2959 - DNA, 22 bp, Homo sapiens
cgctgggagcccacctggtcgg

SEQ ID NO: 2960 - DNA, 22 bp, Homo sapiens
gggcatgttgacgctgaaccgc

SEQ ID NO: 2961 - DNA, 22 bp, Homo sapiens
gcctggccttgccggacttcgc

SEQ ID NO: 2962 - DNA, 49 bp, Homo sapiens
gccatcatctcgtacatcagcacccccagggcccaccagtccacggagg

SEQ ID NO: 2963 - DNA, 22 bp, Homo sapiens
tcagcacccccagggcccacca

SEQ ID NO: 2964 - DNA, 22 bp, Homo sapiens
cccagggcccaccagtccacgg

SEQ ID NO: 2965 - DNA, 29 bp, Homo sapiens
ggcccatccgcacccgctcatacaattcc

SEQ ID NO: 2966 - DNA, 22 bp, Homo sapiens
ggcccatccgcacccgctcata

SEQ ID NO: 2967 - DNA, 22 bp, Homo sapiens
agccggcgctccacatcccctg

SEQ ID NO: 2968 - DNA, 27 bp, Homo sapiens
ccatccacgggcgccttgagcagctcc

SEQ ID NO: 2969 - DNA, 22 bp, Homo sapiens
ccatccacgggcgccttgagca

SEQ ID NO: 2970 - DNA, 28 bp, Homo sapiens
gccccccagcgccagcacacgtttctcc

SEQ ID NO: 2971 - DNA, 22 bp, Homo sapiens
gccccccagcgccagcacacgt

SEQ ID NO: 2972 - DNA, 26 bp, Homo sapiens
gccgcccgcgtgaagaacttgtcaaa

SEQ ID NO: 2973 - DNA, 22 bp, Homo sapiens
gccgcccgcgtgaagaacttgt

SEQ ID NO: 2974 - DNA, 24 bp, Homo sapiens
cgccgccgcctctacagccgcccg

SEQ ID NO: 2975 - DNA, 22 bp, Homo sapiens
ccgccgcctctacagccgcccg

SEQ ID NO: 2976 - DNA, 31 bp, Homo sapiens
gccgtccgccacctacctgccacctgcccgc

SEQ ID NO: 2977 - DNA, 22 bp, Homo sapiens
cacctacctgccacctgcccgc

SEQ ID NO: 2978 - DNA, 22 bp, Homo sapiens
gccgtccgccacctacctgcca

SEQ ID NO: 2979 - DNA, 57 bp, Homo sapiens
atggtgctgctgtccctctgggtcggcatctcctcactcccccgcctcaacgctgga

SEQ ID NO: 2980 - DNA, 22 bp, Homo sapiens
cactcccccgcctcaacgctgg

SEQ ID NO: 2981 - DNA, 23 bp, Homo sapiens
ggtcggcatctcctcactccccc

SEQ ID NO: 2982 - DNA, 23 bp, Homo sapiens
tgctgctgtccctctgggtcggc

SEQ ID NO: 2983 - DNA, 27 bp, Homo sapiens
ggaatggtccccgctgccgccgcctgc

SEQ ID NO: 2984 - DNA, 22 bp, Homo sapiens
ggtccccgctgccgccgcctgc

SEQ ID NO: 2985 - DNA, 28 bp, Homo sapiens
acccaagggtcgcctcgccggagcagcc

SEQ ID NO: 2986 - DNA, 22 bp, Homo sapiens
gggtcgcctcgccggagcagcc

SEQ ID NO: 2987 - DNA, 28 bp, Homo sapiens
gccacctgcccgcagcgccgacccaagg

SEQ ID NO: 2988 - DNA, 22 bp, Homo sapiens
tgcccgcagcgccgacccaagg

SEQ ID NO: 2989 - DNA, 24 bp, Homo sapiens
gccgcctgcgcttgccggagaacc

SEQ ID NO: 2990 - DNA, 22 bp, Homo sapiens
cgcctgcgcttgccggagaacc

SEQ ID NO: 2991 - DNA, 29 bp, Homo sapiens
gccgcctgcgaccgtgtgggacatggtgc

SEQ ID NO: 2992 - DNA, 22 bp, Homo sapiens
gccgcctgcgaccgtgtgggac

SEQ ID NO: 2993 - DNA, 61 bp, Homo sapiens
gggagggcgaggaggaggaggagggcgaggagaagggcgaggaggaggagagaaggaattc

SEQ ID NO: 2994 - DNA, 25 bp, Homo sapiens
gcgaggaggaggagagaaggaattc

SEQ ID NO: 2995 - DNA, 22 bp, Homo sapiens
ggcgaggagaagggcgaggagg

SEQ ID NO: 2996 - DNA, 24 bp, Homo sapiens
gggcgaggaggaggaggagggcga

SEQ ID NO: 2997 - DNA, 42 bp, Homo sapiens
gctcaggccgatctgcagatggaacgagatgcccccgaccgg

SEQ ID NO: 2998 - DNA, 22 bp, Homo sapiens
ggaacgagatgcccccgaccgg

SEQ ID NO: 2999 - DNA, 33 bp, Homo sapiens
gagagccttctccgcctcacaccgctgcaattg

SEQ ID NO: 3000 - DNA, 22 bp, Homo sapiens
tctccgcctcacaccgctgcaa

SEQ ID NO: 3001 - DNA, 25 bp, Homo sapiens
caagccctgcctgaaaagccccttc

SEQ ID NO: 3002 - DNA, 22 bp, Homo sapiens
caagccctgcctgaaaagcccc

SEQ ID NO: 3003 - DNA, 31 bp, Homo sapiens
gggctggcggcgcggcagcaggaaagttttg

SEQ ID NO: 3004 - DNA, 22 bp, Homo sapiens
ctggcggcgcggcagcaggaaa

SEQ ID NO: 3005 - DNA, 29 bp, Homo sapiens
ccgccacgggcagcagcggactgggcggc

SEQ ID NO: 3006 - DNA, 22 bp, Homo sapiens
cgggcagcagcggactgggcgg

SEQ ID NO: 3007 - DNA, 28 bp, Homo sapiens
ccggaccctgggaccagtgcggcggccg

SEQ ID NO: 3008 - DNA, 22 bp, Homo sapiens
ccctgggaccagtgcggcggcc

SEQ ID NO: 3009 - DNA, 22 bp, Homo sapiens
gccgcgacaggagccaagaacg

SEQ ID NO: 3010 - DNA, 23 bp, Homo sapiens
gccgtttccgcagcgtgtccttg

SEQ ID NO: 3011 - DNA, 39 bp, Homo sapiens
gcatcacacttgagtccttgccgtgccagtccccacagc

SEQ ID NO: 3012 - DNA, 22 bp, Homo sapiens
ccttgccgtgccagtccccaca

SEQ ID NO: 3013 - DNA, 42 bp, Homo sapiens
ggtgctggcggatgtctcccctcacgcccagcctcttctcag

SEQ ID NO: 3014 - DNA, 22 bp, Homo sapiens
cggatgtctcccctcacgccca

SEQ ID NO: 3015 - DNA, 23 bp, Homo sapiens
cccctcacgcccagcctcttctc

SEQ ID NO: 3016 - DNA, 22 bp, Homo sapiens
tgctggcggatgtctcccctca

SEQ ID NO: 3017 - DNA, 30 bp, Homo sapiens
ccgaaacaaagggtgctggcggatgtctcc

SEQ ID NO: 3018 - DNA, 22 bp, Homo sapiens
cgaaacaaagggtgctggcgga

SEQ ID NO: 3019 - DNA, 22 bp, Homo sapiens
cgacatggttgcgccctggagc

SEQ ID NO: 3020 - DNA, 25 bp, Homo sapiens
gcttgatggcaccccggcgctgatg

SEQ ID NO: 3021 - DNA, 22 bp, Homo sapiens
gcttgatggcaccccggcgctg

SEQ ID NO: 3022 - DNA, 20 bp, Homo sapiens
gggtcggtcctgctgggcat

SEQ ID NO: 3023 - DNA, 25 bp, Homo sapiens
cggccgccgctcccttccatcttgg

SEQ ID NO: 3024 - DNA, 22 bp, Homo sapiens
cggccgccgctcccttccatct

SEQ ID NO: 3025 - DNA, 47 bp, Homo sapiens
cgtccacgctggtgatgaagatgtcccccccgtaatgcgccttgagg

SEQ ID NO: 3026 - DNA, 23 bp, Homo sapiens
gtcccccccgtaatgcgccttga

SEQ ID NO: 3027 - DNA, 22 bp, Homo sapiens
ggtgatgaagatgtcccccccg

SEQ ID NO: 3028 - DNA, 27 bp, Homo sapiens
agctcctcgaaggtcgtggcggcgtcc

SEQ ID NO: 3029 - DNA, 22 bp, Homo sapiens
ctcctcgaaggtcgtggcggcg

SEQ ID NO: 3030 - DNA, 27 bp, Homo sapiens
cctgcactgacgggccaggcggaaagc

SEQ ID NO: 3031 - DNA, 22 bp, Homo sapiens
tgcactgacgggccaggcggaa

SEQ ID NO: 3032 - DNA, 30 bp, Homo sapiens
gtcttctcccggacatggcaggccaggctg

SEQ ID NO: 3033 - DNA, 22 bp, Homo sapiens
tcccggacatggcaggccaggc

SEQ ID NO: 3034 - DNA, 32 bp, Homo sapiens
catcttctggctccccggcggtagatagattt

SEQ ID NO: 3035 - DNA, 22 bp, Homo sapiens
catcttctggctccccggcggt

SEQ ID NO: 3036 - DNA, 22 bp, Homo sapiens
cgtggcagcgcttatggaccag

SEQ ID NO: 3037 - DNA, 23 bp, Homo sapiens
gggacgaggccgtggcagcgctt

SEQ ID NO: 3038 - DNA, 28 bp, Homo sapiens
gcttcctgcaggtcagcgggacgaggcc

SEQ ID NO: 3039 - DNA, 22 bp, Homo sapiens
tgcaggtcagcgggacgaggcc

SEQ ID NO: 3040 - DNA, 30 bp, Homo sapiens
cgtacgtcccgcgcccgatgactctgatta

SEQ ID NO: 3041 - DNA, 22 bp, Homo sapiens
cgtcccgcgcccgatgactctg

SEQ ID NO: 3042 - DNA, 39 bp, Homo sapiens
atctcaaacatgaggactcccagcgcccaccagtccacg

SEQ ID NO: 3043 - DNA, 22 bp, Homo sapiens
tcccagcgcccaccagtccacg

SEQ ID NO: 3044 - DNA, 26 bp, Homo sapiens
ggagcgcccggccatcatctcaaaca

SEQ ID NO: 3045 - DNA, 22 bp, Homo sapiens
ggagcgcccggccatcatctca

SEQ ID NO: 3046 - DNA, 35 bp, Homo sapiens
accgttcaacacagaaaccccagaatcgcttcctc

SEQ ID NO: 3047 - DNA, 22 bp, Homo sapiens
gaaaccccagaatcgcttcctc

SEQ ID NO: 3048 - DNA, 32 bp, Homo sapiens
gctgaagcccacaatgcccgttcaagtcccct

SEQ ID NO: 3049 - DNA, 22 bp, Homo sapiens
aagcccactaagcccgttcaag

SEQ ID NO: 3050 - DNA, 30 bp, Homo sapiens
gaactcctcccaactcggctcaaagacggg

SEQ ID NO: 3051 - DNA, 22 bp, Homo sapiens
tcccaactcggctcaaagacgg

SEQ ID NO: 3052 - DNA, 31 bp, Homo sapiens
ggcagaatctttctccgcccatccttcaccg

SEQ ID NO: 3053 - DNA, 22 bp, Homo sapiens
tttctccgcccatccttcaccg

SEQ ID NO: 3054 - DNA, 23 bp, Homo sapiens
ggcagccagccccacatctaagc

SEQ ID NO: 3055 - DNA, 22 bp, Homo sapiens
gcagccagccccacatctaagc

SEQ ID NO: 3056 - DNA, 43 bp, Homo sapiens
cgcccagtccgttctctccatgcccgtgctgctgctacctgtg

SEQ ID NO: 3057 - DNA, 22 bp, Homo sapiens
gcccgtgctgctgctacctgtg

SEQ ID NO: 3058 - DNA, 28 bp, Homo sapiens
aaacgtccgcccagtccgttctctccat

SEQ ID NO: 3059 - DNA, 22 bp, Homo sapiens
tccgcccagtccgttctctcca

SEQ ID NO: 3060 - DNA, 52 bp, Homo sapiens
gtctctagcctgggccttcgagaccgcatacaaagagggcaaaggaatttta

SEQ ID NO: 3061 - DNA, 22 bp, Homo sapiens
ccgcatacaaagagggcaaagg

SEQ ID NO: 3062 - DNA, 22 bp, Homo sapiens
agcctgggccttcgagaccgca

SEQ ID NO: 3063 - DNA, 39 bp, Homo sapiens
ttcagttttttctcgagccgcctgttccaccatacgctg

SEQ ID NO: 3064 - DNA, 22 bp, Homo sapiens
gccgcctgttccaccatacgct

SEQ ID NO: 3065 - DNA, 27 bp, Homo sapiens
ggtggtgctggacctgggctaactggc

SEQ ID NO: 3066 - DNA, 22 bp, Homo sapiens
tgctggacctgggctaactggc

SEQ ID NO: 3067 - DNA, 27 bp, Homo sapiens
gggcactctggcggtggcacgaactcc

SEQ ID NO: 3068 - DNA, 22 bp, Homo sapiens
gggcactctggcggtggcacga

SEQ ID NO: 3069 - DNA, 30 bp, Homo sapiens
ccagtccttgggcggccgaattttgcagat

SEQ ID NO: 3070 - DNA, 22 bp, Homo sapiens
ccttgggcggccgaattttgca

SEQ ID NO: 3071 - DNA, 34 bp, Homo sapiens
aaataatttcaacgtcccctgagaaaaaccggaa

SEQ ID NO: 3072 - DNA, 22 bp, Homo sapiens
cgtcccctgagaaaaaccggaa

SEQ ID NO: 3073 - DNA, 38 bp, Homo sapiens
aggcaggtcctccgggccgctgtcctgctctgggtcct

SEQ ID NO: 3074 - DNA, 22 bp, Homo sapiens
gccgctgtcctgctctgggtcc

SEQ ID NO: 3075 - DNA, 41 bp, Homo sapiens
tatccgtgcactcctttgctgaccgcttccgggtgttcgag

SEQ ID NO: 3076 - DNA, 22 bp, Homo sapiens
tcctgttctgacctcgcctggg

SEQ ID NO: 3077 - DNA, 31 bp, Homo sapiens
cttctgggtctggaaggcagtggttgcttgt

SEQ ID NO: 3078 - DNA, 22 bp, Homo sapiens
gggtctggaaggctgaggttgc

SEQ ID NO: 3079 - DNA, 31 bp, Homo sapiens
gggcacgccccgtcctctcccgactcccgtt

SEQ ID NO: 3080 - DNA, 22 bp, Homo sapiens
ggcacgccccgtcctctcccga

SEQ ID NO: 3081 - DNA, 23 bp, Homo sapiens
ggggaggaccaggcgcgcgcagc

SEQ ID NO: 3082 - DNA, 22 bp, Homo sapiens
gggaggacgacgcgcgcgcacg

SEQ ID NO: 3083 - DNA, 37 bp, Homo sapiens
tgtggccatcataacctcaagagcgcacgccaataaa

SEQ ID NO: 3084 - DNA, 22 bp, Homo sapiens
caacctcaagagcgcacgccaa

SEQ ID NO: 3085 - DNA, 22 bp, Homo sapiens
gggcctggtggaagcatactgc

SEQ ID NO: 3086 - DNA, 25 bp, Homo sapiens
cgggtgacaggcggcggcggcggcg

SEQ ID NO: 3087 - DNA, 22 bp, Homo sapiens
cgggtgacaggcggcggcggcg

SEQ ID NO: 3088 - DNA, 42 bp, Homo sapiens
ggtcaacccctcaagccgtccgccgacgcccactgtggtgtg

SEQ ID NO: 3089 - DNA, 22 bp, Homo sapiens
tccgccgacgcccactgtggtg

SEQ ID NO: 3090 - DNA, 22 bp, Homo sapiens
ccctcaagccgtccgccgacgc

SEQ ID NO: 3091 - DNA, 43 bp, Homo sapiens
tctcaccgtcctacacgcccagccagccaaagcctccccacct

SEQ ID NO: 3092 - DNA, 22 bp, Homo sapiens
cgcccagccagccaaagcctcc

SEQ ID NO: 3093 - DNA, 37 bp, Homo sapiens
gccgccgctgcctgcaaagtcccggccacggaattcc

SEQ ID NO: 3094 - DNA, 21 bp, Homo sapiens
aagtcccggccacggaattcc

SEQ ID NO: 3095 - DNA, 22 bp, Homo sapiens
cctgcaaagtcccggccacgga

SEQ ID NO: 3096 - DNA, 22 bp, Homo sapiens
cgccgctgcctgcaaagtcccg

SEQ ID NO: 3097 - DNA, 24 bp, Homo sapiens
cgctccgcccccggccgccgctgc

SEQ ID NO: 3098 - DNA, 21 bp, Homo sapiens
gctccgcccccggccgccgct

SEQ ID NO: 3099 - DNA, 22 bp, Homo sapiens
gctcgatcccgctccgcccccg

SEQ ID NO: 3100 - DNA, 27 bp, Homo sapiens
ccccggccaaggccatgacgctcacgg

SEQ ID NO: 3101 - DNA, 22 bp, Homo sapiens
ccccggccaaggccatgacgct

SEQ ID NO: 3102 - DNA, 40 bp, Homo sapiens
cgaggagtcgagcagccgcagcgcgccggccccgagcagg

SEQ ID NO: 3103 - DNA, 22 bp, Homo sapiens
gcagcgcgccggccccgagcag

SEQ ID NO: 3104 - DNA, 22 bp, Homo sapiens
agtcgagcagccgcagcgcgcc

SEQ ID NO: 3105 - DNA, 23 bp, Homo sapiens
tgggaggacggccagggacaggg

SEQ ID NO: 3106 - DNA, 22 bp, Homo sapiens
gggaggacggccagggacaggg

SEQ ID NO: 3107 - DNA, 45 bp, Homo sapiens
ggccgaaagtgcagttagagcccccccacgcgcagagatggactc

SEQ ID NO: 3108 - DNA, 22 bp, Homo sapiens
gcccccccacgcgcagagatgg

SEQ ID NO: 3109 - DNA, 38 bp, Homo sapiens
gagcaattctccttcgtcccctcggagattttaattct

SEQ ID NO: 3110 - DNA, 22 bp, Homo sapiens
gcaattctccttcgtcccctcg

SEQ ID NO: 3111 - DNA, 22 bp, Homo sapiens
ccttcgtcccctcggagatttt

SEQ ID NO: 3112 - DNA, 31 bp, Homo sapiens
gaggtcgtccccgttttgacttctgcctctc

SEQ ID NO: 3113 - DNA, 22 bp, Homo sapiens
cgtccccgttttgacttctgcc

SEQ ID NO: 3114 - DNA, 45 bp, Homo sapiens
caaatctacttcatggcaaaccaaggtttcaggcccgatcagagg

SEQ ID NO: 3115 - DNA, 22 bp, Homo sapiens
gcaaaccaaggtttcaggcccg

SEQ ID NO: 3116 - DNA, 45 bp, Homo sapiens
gttatgttggactacaggaggtagggcaggtggaatagaaacaag

SEQ ID NO: 3117 - DNA, 22 bp, Homo sapiens
acaggaggtagggcaggtggaa

SEQ ID NO: 3118 - DNA, 46 bp, Homo sapiens
ctgatgaagcagatgacatggaggctcccgcatgagacacttccct

SEQ ID NO: 3119 - DNA, 22 bp, Homo sapiens
tggaggctcccgcatgagacac

SEQ ID NO: 3120 - DNA, 22 bp, Homo sapiens
agatgacatggaggctcccgca

SEQ ID NO: 3121 - DNA, 62 bp, Homo sapiens
ctgtcctgagctcatccccgtcttccgccaccgctccctttttcccacgcttcggcattccc

SEQ ID NO: 3122 - DNA, 22 bp, Homo sapiens
tttcccacgcttcggcattccc

SEQ ID NO: 3123 - DNA, 22 bp, Homo sapiens
ccgccaccgctccctttttccc

SEQ ID NO: 3124 - DNA, 22 bp, Homo sapiens
ccccgtcttccgccaccgctcc

SEQ ID NO: 3125 - DNA, 34 bp, Homo sapiens
cctgatcatgctcctcgtcgcctatgccgtaaga

SEQ ID NO: 3126 - DNA, 22 bp, Homo sapiens
tgctcctcgtcgcctatgccgt

SEQ ID NO: 3127 - DNA, 29 bp, Homo sapiens
gcccgatggcagcctagctcctcctaacg

SEQ ID NO: 3128 - DNA, 22 bp, Homo sapiens
ggcagcctagctcctcctaacg

SEQ ID NO: 3129 - DNA, 24 bp, Homo sapiens
cgtatctgcaccggcccgatggca

SEQ ID NO: 3130 - DNA, 22 bp, Homo sapiens
tatctgcaccggcccgatggca

SEQ ID NO: 3131 - DNA, 31 bp, Homo sapiens
ggaaagcaggcccacgccactgtacccttcc

SEQ ID NO: 3132 - DNA, 22 bp, Homo sapiens
gcaggcccacgccactgtaccc

SEQ ID NO: 3133 - DNA, 41 bp, Homo sapiens
gccgtaagaaactttgagtgggcactggcgggaaagcaggc

SEQ ID NO: 3134 - DNA, 22 bp, Homo sapiens
gggcactggcgggaaagcaggc

SEQ ID NO: 3135 - DNA, 49 bp, Homo sapiens
caggaacttgcgaaaggcttcatcccagcgctgccggtactccagtcgt

SEQ ID NO: 3136 - DNA, 22 bp, Homo sapiens
ggcttcatcccagcgctgccgg

SEQ ID NO: 3137 - DNA, 22 bp, Homo sapiens
gcgaaaggcttcatcccagcgc

SEQ ID NO: 3138 - DNA, 42 bp, Homo sapiens
acagcctgcagtaattccccgaagccttggcgctcttgtggc

SEQ ID NO: 3139 - DNA, 22 bp, Homo sapiens
ccccgaagccttggcgctcttg

SEQ ID NO: 3140 - DNA, 40 bp, Homo sapiens
acagtgatcactgccgagggccttggaacggatcttgctg

SEQ ID NO: 3141 - DNA, 22 bp, Homo sapiens
gggccttggaacggatcttgct

SEQ ID NO: 3142 - DNA, 22 bp, Homo sapiens
cactgccgagggccttggaacg

SEQ ID NO: 3143 - DNA, 30 bp, Homo sapiens
ggcctcctccttcttcccgccctccgctgg

SEQ ID NO: 3144 - DNA, 22 bp, Homo sapiens
ccttcttcccgccctccgctgg

SEQ ID NO: 3145 - DNA, 36 bp, Homo sapiens
ggaggccatggctccgctccccgcaccttcccgcag

SEQ ID NO: 3146 - DNA, 22 bp, Homo sapiens
ccgctccccgcaccttcccgca

SEQ ID NO: 3147 - DNA, 36 bp, Homo sapiens
tctgtgctgtgctcccctggaatgctgcctgctgat

SEQ ID NO: 3148 - DNA, 22 bp, Homo sapiens
cccctggaatgctgcctgctga

SEQ ID NO: 3149 - DNA, 26 bp, Homo sapiens
gggcccccagtcccccgancacccta

SEQ ID NO: 3150 - DNA, 22 bp, Homo sapiens
gcccccagtcccccgancaccc

SEQ ID NO: 3151 - DNA, 30 bp, Homo sapiens
ctcagtgggtttgtattgcctgagcgtggg

SEQ ID NO: 3152 - DNA, 22 bp, Homo sapiens
gtttgtattgcctgagcgtggg

SEQ ID NO: 3153 - DNA, 36 bp, Homo sapiens
aggtgtgagcncctgcgcctggcctctgagttgtct

SEQ ID NO: 3154 - DNA, 22 bp, Homo sapiens
cctgcgcctggcctctgagttg

SEQ ID NO: 3155 - DNA, 30 bp, Homo sapiens
cgacccccgcggcggagtagaaggcggcgg

SEQ ID NO: 3156 - DNA, 22 bp, Homo sapiens
gcggcggagtagaaggcggcgg

SEQ ID NO: 3157 - DNA, 30 bp, Homo sapiens
cgcctctccgccctcagcctcctcctcacg

SEQ ID NO: 3158 - DNA, 22 bp, Homo sapiens
cgcctctccgccctcagcctcc

SEQ ID NO: 3159 - DNA, 51 bp, Homo sapiens
cataattcatgttaggcttgttcttgcgaatcccccagagacgagccacct

SEQ ID NO: 3160 - DNA, 22 bp, Homo sapiens
gcgaatcccccagagacgagcc

SEQ ID NO: 3161 - DNA, 37 bp, Homo sapiens
gggtatggacgaaatgggtggtgtggtggcaaaagca

SEQ ID NO: 3162 - DNA, 22 bp, Homo sapiens
tgggtggtgtggtggcaaaagc

SEQ ID NO: 3163 - DNA, 40 bp, Homo sapiens
gaaggcatccggctccccaaagaacccgctgccgagagag

SEQ ID NO: 3164 - DNA, 22 bp, Homo sapiens
tccccaaagaacccgctgccga

SEQ ID NO: 3165 - DNA, 41 bp, Homo sapiens
gcaaaggccccgttcacattctgctgccgccatcgctcccg

SEQ ID NO: 3166 - DNA, 22 bp, Homo sapiens
tctgctgccgccatcgctcccg

SEQ ID NO: 3167 - DNA, 49 bp, Homo sapiens
gcgcgccgccccctcccccacctccacccccaccagcccccaccacagg

SEQ ID NO: 3168 - DNA, 22 bp, Homo sapiens
ccacccccaccagcccccacca

SEQ ID NO: 3169 - DNA, 26 bp, Homo sapiens
cggctccatcggcggcaggcagcatg

SEQ ID NO: 3170 - DNA, 22 bp, Homo sapiens
cggctccatcggcggcaggcag

SEQ ID NO: 3171 - DNA, 59 bp, Homo sapiens
attctcaccccacctgccctgaagcccaccatcccagcagcctaagaacgccctcctgg

SEQ ID NO: 3172 - DNA, 22 bp, Homo sapiens
cccacctgccctgaagcccacc

SEQ ID NO: 3173 - DNA, 41 bp, Homo sapiens
gaaggatttgggactgagggaagagggaagaccgtgccgtc

SEQ ID NO: 3174 - DNA, 22 bp, Homo sapiens
gggaagagggaagaccgtgccg

SEQ ID NO: 3175 - DNA, 48 bp, Homo sapiens
gtacggagagaagggcatcaagctgcggacgatgcgggacttgggaaa

SEQ ID NO: 3176 - DNA, 22 bp, Homo sapiens
tgcggacgatgcgggacttggg

SEQ ID NO: 3177 - DNA, 22 bp, Homo sapiens
gggcatcaagctgcggacgatg

SEQ ID NO: 3178 - DNA, 42 bp, Homo sapiens
tatgaattctgttggcgggtgctggaaggccgggctgtggaa

SEQ ID NO: 3179 - DNA, 22 bp, Homo sapiens
tgctggaaggccgggctgtgga

SEQ ID NO: 3180 - DNA, 23 bp, Homo sapiens
tctgttggcgggtgctggaaggc

SEQ ID NO: 3181 - DNA, 42 bp, Homo sapiens
cttcgccttgcgtgaggtttgccagccgggacacccagttaa

SEQ ID NO: 3182 - DNA, 22 bp, Homo sapiens
ggtttgccagccgggacaccca

SEQ ID NO: 3183 - DNA, 22 bp, Homo sapiens
tgcgtgaggtttgccagccggg

SEQ ID NO: 3184 - DNA, 23 bp, Homo sapiens
gggagaggctgggcggagttggg

SEQ ID NO: 3185 - DNA, 33 bp, Homo sapiens
ggttcaggaactcctcaagctggcggccaacca

SEQ ID NO: 3186 - DNA, 23 bp, Homo sapiens
ggaactcctcaagctggcggcca

SEQ ID NO: 3187 - DNA, 38 bp, Homo sapiens
tctatgatgctggacgcgcggctgaagtggtcctgcat

SEQ ID NO: 3188 - DNA, 22 bp, Homo sapiens
gctggacgcgcggctgaagtgg

SEQ ID NO: 3189 - DNA, 23 bp, Homo sapiens
cgcgcggctgaagtggtcctgca

SEQ ID NO: 3190 - DNA, 38 bp, Homo sapiens
acactggtccttcatccgcaggcagcccgtggagttgt

SEQ ID NO: 3191 - DNA, 23 bp, Homo sapiens
ccgcaggcagcccgtggagttgt

SEQ ID NO: 3192 - DNA, 22 bp, Homo sapiens
tccttcatccgcaggcagcccg

SEQ ID NO: 3193 - DNA, 39 bp, Homo sapiens
ggattcgtcgagctcccgccgcagcttagcctgggaggg

SEQ ID NO: 3194 - DNA, 22 bp, Homo sapiens
tcccgccgcagcttagcctggg

SEQ ID NO: 3195 - DNA, 22 bp, Homo sapiens
ttcgtcgagctcccgccgcagc

SEQ ID NO: 3196 - DNA, 31 bp, Homo sapiens
aagtgtgggaagccaccgtggtgacccgcag

SEQ ID NO: 3197 - DNA, 22 bp, Homo sapiens
ggaagccaccgtggtgacccgc

SEQ ID NO: 3198 - DNA, 38 bp, Homo sapiens
tgggtgtgagagtggtgttgctgctgctggtctgcccc

SEQ ID NO: 3199 - DNA, 22 bp, Homo sapiens
gttgctgctgctggtctgcccc

SEQ ID NO: 3200 - DNA, 29 bp, Homo sapiens
gggttgggcatctgggctgttttctcctt

SEQ ID NO: 3201 - DNA, 22 bp, Homo sapiens
gggttgggcatctgggctgttt

SEQ ID NO: 3202 - DNA, 47 bp, Homo sapiens
atgctgtttctttttgccaggatcccccgagccccttccttcactgt

SEQ ID NO: 3203 - DNA, 22 bp, Homo sapiens
tcccccgagccccttccttcac

SEQ ID NO: 3204 - DNA, 22 bp, Homo sapiens
ttgccaggatcccccgagcccc

SEQ ID NO: 3205 - DNA, 28 bp, Homo sapiens
caggtgcatgcttcccgccgggtcctcc

SEQ ID NO: 3206 - DNA, 22 bp, Homo sapiens
catgcttcccgccgggtcctcc

SEQ ID NO: 3207 - DNA, 26 bp, Homo sapiens
gccccgggtgcctgatctcagaagcc

SEQ ID NO: 3208 - DNA, 22 bp, Homo sapiens
gccccgggtgcctgatctcaga

SEQ ID NO: 3209 - DNA, 31 bp, Homo sapiens
gcggccgcctcctcctcgtcgtcgcccggcg

SEQ ID NO: 3210 - DNA, 23 bp, Homo sapiens
cgcctcctcctcgtcgtcgcccg

SEQ ID NO: 3211 - DNA, 31 bp, Homo sapiens
gctccacctgccgcaacttgaccaagtgtga

SEQ ID NO: 3212 - DNA, 22 bp, Homo sapiens
tccacctgccgcaacttgacca

SEQ ID NO: 3213 - DNA, 33 bp, Homo sapiens
gccatcgccgctgccgctgccgcctcctcctcc

SEQ ID NO: 3214 - DNA, 22 bp, Homo sapiens
gccgctgccgctgccgcctcct

SEQ ID NO: 3215 - DNA, 23 bp, Homo sapiens
cgcggtggctcggaggaggctgt

SEQ ID NO: 3216 - DNA, 22 bp, Homo sapiens
cgcggtggctcggaggaggctg

SEQ ID NO: 3217 - DNA, 41 bp, Homo sapiens
gccaacctgcccagtccctcctccggcagccacgttgttta

SEQ ID NO: 3218 - DNA, 22 bp, Homo sapiens
acctgcccagtccctcctccgg

SEQ ID NO: 3219 - DNA, 22 bp, Homo sapiens
ccctcctccggcagccacgttg

SEQ ID NO: 3220 - DNA, 30 bp, Homo sapiens
gctctgccgctcgccctcctcctcatctga

SEQ ID NO: 3221 - DNA, 22 bp, Homo sapiens
gctctgccgctcgccctcctcc

SEQ ID NO: 3222 - DNA, 35 bp, Homo sapiens
gtcatcttcttgcggttgcccttctggatgcccca

SEQ ID NO: 3223 - DNA, 23 bp, Homo sapiens
gcggttgcccttctggatgcccc

SEQ ID NO: 3224 - DNA, 39 bp, Homo sapiens
caccttcttgacctcgcccgtcttgccgtagttgcgcag

SEQ ID NO: 3225 - DNA, 23 bp, Homo sapiens
cgcccgtcttgccgtagttgcgc

SEQ ID NO: 3226 - DNA, 35 bp, Homo sapiens
gagtcctggagggaggcgaagcgggatgtggaggg

SEQ ID NO: 3227 - DNA, 22 bp, Homo sapiens
gggaggcgaagcgggatgtgga

SEQ ID NO: 3228 - DNA, 25 bp, Homo sapiens
agggccagcacaagttcctgatttt

SEQ ID NO: 3229 - DNA, 42 bp, Homo sapiens
agatgctgtccttcatgtcgccgctgcggagcaggtccaaca

SEQ ID NO: 3230 - DNA, 22 bp, Homo sapiens
tcgccgctgcggagcaggtcca

SEQ ID NO: 3231 - DNA, 37 bp, Homo sapiens
tggatgccccagcggtgcgccagcgcctccttgtgct

SEQ ID NO: 3232 - DNA, 22 bp, Homo sapiens
cggtgcgccagcgcctccttgt

SEQ ID NO: 3233 - DNA, 22 bp, Homo sapiens
atgccccagcggtgcgccagcg

SEQ ID NO: 3234 - DNA, 27 bp, Homo sapiens
gcagcgcgcgcgccatcttctggtagg

SEQ ID NO: 3235 - DNA, 22 bp, Homo sapiens
gcagcgcgcgcgccatcttctg

SEQ ID NO: 3236 - DNA, 34 bp, Homo sapiens
ggagcgtcctccctgtgtccgggccgggcgaggg

SEQ ID NO: 3237 - DNA, 22 bp, Homo sapiens
cctgtgtccgggccgggcgagg

SEQ ID NO: 3238 - DNA, 22 bp, Homo sapiens
ggagcgtcctccctgtgtccgg

SEQ ID NO: 3239 - DNA, 25 bp, Homo sapiens
ggagcccggcccgccacagtcctgc

SEQ ID NO: 3240 - DNA, 22 bp, Homo sapiens
gcccggcccgccacagtcctgc

SEQ ID NO: 3241 - DNA, 51 bp, Homo sapiens
agcttctggtaggtcatgcgcttgcggttccccttctgctggccccagcgg

SEQ ID NO: 3242 - DNA, 21 bp, Homo sapiens
gcggttccccttctgctgccc

SEQ ID NO: 3243 - DNA, 22 bp, Homo sapiens
ggtcatgcgcttgcggttcccc

SEQ ID NO: 3244 - DNA, 27 bp, Homo sapiens
ccggtcttggcgtagtttcggagggcg

SEQ ID NO: 3245 - DNA, 25 bp, Homo sapiens
cggtcttggcgtagtttcggagggc

SEQ ID NO: 3246 - DNA, 30 bp, Homo sapiens
gagtccctgcctcggatcccttcccctcgg

SEQ ID NO: 3247 - DNA, 22 bp, Homo sapiens
ccctgcctcggatcccttcccc

SEQ ID NO: 3248 - DNA, 32 bp, Homo sapiens
gcatgtccccgcgcgtcagtagccccagcagg

SEQ ID NO: 3249 - DNA, 22 bp, Homo sapiens
tccccgcgcgtcagtagcccca

SEQ ID NO: 3250 - DNA, 28 bp, Homo sapiens
ccggcgcctggctccacccaccacacgc

SEQ ID NO: 3251 - DNA, 22 bp, Homo sapiens
cggcgcctggctccacccacca

SEQ ID NO: 3252 - DNA, 41 bp, Homo sapiens
cctttgctggccccagcggcgcgccaggagttccttgtgct

SEQ ID NO: 3253 - DNA, 22 bp, Homo sapiens
ccccagcggcgcgccaggagtt

SEQ ID NO: 3254 - DNA, 32 bp, Homo sapiens
gtagtttcggagggcgcgcgccagcttctggt

SEQ ID NO: 3255 - DNA, 24 bp, Homo sapiens
ttcggagggcgcgcgccagcttct

SEQ ID NO: 3256 - DNA, 28 bp, Homo sapiens
ggtgtgctcaggcccggcggactgcagg

SEQ ID NO: 3257 - DNA, 22 bp, Homo sapiens
tgctcaggcccggcggactgca

SEQ ID NO: 3258 - DNA, 32 bp, Homo sapiens
gacgtgaggtcccccagcggctccgcaggtgg

SEQ ID NO: 3259 - DNA, 22 bp, Homo sapiens
gaggtcccccagcggctccgca

SEQ ID NO: 3260 - DNA, 25 bp, Homo sapiens
ggagccgccgcagccgccgccatcg

SEQ ID NO: 3261 - DNA, 22 bp, Homo sapiens
ggagccgccgcagccgccgcca

SEQ ID NO: 3262 - DNA, 22 bp, Homo sapiens
gggtggttgccgccgctgcctc

SEQ ID NO: 3263 - DNA, 22 bp, Homo sapiens
gggtggttgccgccgctgccgc

SEQ ID NO: 3264 - DNA, 28 bp, Homo sapiens
gagtcgccctcgctgccgctgtagaggg

SEQ ID NO: 3265 - DNA, 22 bp, Homo sapiens
tcgccctcgctgccgctgtaga

SEQ ID NO: 3266 - DNA, 32 bp, Homo sapiens
gatctccatctcgctcaggctccgcttcaggc

SEQ ID NO: 3267 - DNA, 22 bp, Homo sapiens
tcgctcaggctccgcttcaggc

SEQ ID NO: 3268 - DNA, 45 bp, Homo sapiens
gtgaggtctgtgctgctgtcacgggagggagacgcttgctgtggg

SEQ ID NO: 3269 - DNA, 22 bp, Homo sapiens
cacgggagggagacgcttgctg

SEQ ID NO: 3270 - DNA, 45 bp, Homo sapiens
ctcagtcctgtggctgcccgttcctcctccccgcctccctcctgc

SEQ ID NO: 3271 - DNA, 22 bp, Homo sapiens
ggctgcccgttcctcctccccg

SEQ ID NO: 3272 - DNA, 36 bp, Homo sapiens
gggaggctgagggaggacgggtggaggcaggcaggc

SEQ ID NO: 3273 - DNA, 22 bp, Homo sapiens
ggacgggtggaggcaggcaggc

SEQ ID NO: 3274 - DNA, 22 bp, Homo sapiens
ggaggctgagggaggacgggtg

SEQ ID NO: 3275 - DNA, 22 bp, Homo sapiens
gcaaggaggctggcaagagggc

SEQ ID NO: 3276 - DNA, 26 bp, Homo sapiens
gggagcggcaaggcagggcaggcggc

SEQ ID NO: 3277 - DNA, 22 bp, Homo sapiens
gcggcaaggcagggcaggcggc

SEQ ID NO: 3278 - DNA, 44 bp, Homo sapiens
cagttgcctctgcctgacgccctcccaccccaaccccgacattt

SEQ ID NO: 3279 - DNA, 22 bp, Homo sapiens
tctgcctgacgccctcccaccc

SEQ ID NO: 3280 - DNA, 45 bp, Homo sapiens
tctgacccccattcctgcctctcaccccctcccagaccccaccct

SEQ ID NO: 3281 - DNA, 22 bp, Homo sapiens
tcaccccctcccagaccccacc

SEQ ID NO: 3282 - DNA, 22 bp, Homo sapiens
ccccattcctgcctctcacccc

SEQ ID NO: 3283 - DNA, 31 bp, Homo sapiens
cccatttctggctcccctttggctgcactca

SEQ ID NO: 3284 - DNA, 22 bp, Homo sapiens
tttctggctcccctttggctgc

SEQ ID NO: 3285 - DNA, 31 bp, Homo sapiens
ggtaaaagaccctcccccctatgctggccca

SEQ ID NO: 3286 - DNA, 22 bp, Homo sapiens
agaccctcccccctatgctggc

SEQ ID NO: 3287 - DNA, 54 bp, Homo sapiens
ctgatttgccatgccccagccttgaaagccacccataagccccagctagtctcc

SEQ ID NO: 3288 - DNA, 22 bp, Homo sapiens
aaagccacccataagccccagc

SEQ ID NO: 3289 - DNA, 39 bp, Homo sapiens
cccacacacacataccccagagccaccgaggaagggaaa

SEQ ID NO: 3290 - DNA, 22 bp, Homo sapiens
accccagagccaccgaggaagg

SEQ ID NO: 3291 - DNA, 23 bp, Homo sapiens
ccctcgctgtctggctgctccgc

SEQ ID NO: 3292 - DNA, 59 bp, Homo sapiens
ttctcccgaccagctcgtccctcctcccgctcctcctccccctcctccccgcagtggcg

SEQ ID NO: 3293 - DNA, 22 bp, Homo sapiens
tccccctcctccccgcagtggc

SEQ ID NO: 3294 - DNA, 23 bp, Homo sapiens
gctcctcctccccctcctccccg

SEQ ID NO: 3295 - DNA, 22 bp, Homo sapiens
tcgtccctcctcccgctcctcc

SEQ ID NO: 3296 - DNA, 28 bp, Homo sapiens
gggtccccaagtcctgcctcctcgcggg

SEQ ID NO: 3297 - DNA, 22 bp, Homo sapiens
cccaagtcctgcctcctcgcgg

SEQ ID NO: 3298 - DNA, 26 bp, Homo sapiens
ccggcggcaaagggaggcggtctggg

SEQ ID NO: 3299 - DNA, 22 bp, Homo sapiens
cggcggcaaagggaggcggtct

SEQ ID NO: 3300 - DNA, 48 bp, Homo sapiens
gcgtcagcaccagtagccacagcagcggtagcagcagcggcagcagcc

SEQ ID NO: 3301 - DNA, 23 bp, Homo sapiens
cggtagcagcagcggcagcagcc

SEQ ID NO: 3302 - DNA, 22 bp, Homo sapiens
cagcagcggtagcagcagcggc

SEQ ID NO: 3303 - DNA, 22 bp, Homo sapiens
gcaccagtagccacagcagcgg

SEQ ID NO: 3304 - DNA, 23 bp, Homo sapiens
ggcggcacctccccctggctcgg

SEQ ID NO: 3305 - DNA, 22 bp, Homo sapiens
gcggcacctccccctggctcgg

SEQ ID NO: 3306 - DNA, 34 bp, Homo sapiens
gccctcaatttcccctccacggctcaaccactgc

SEQ ID NO: 3307 - DNA, 23 bp, Homo sapiens
cccctccacggctcaaccactgc

SEQ ID NO: 3308 - DNA, 22 bp, Homo sapiens
gccctcaatttcccctccacgg

SEQ ID NO: 3309 - DNA, 39 bp, Homo sapiens
gagctgaagcaatagttggtgtccagggctcggcggtgc

SEQ ID NO: 3310 - DNA, 22 bp, Homo sapiens
ggtgtccagggctcggcggtgc

SEQ ID NO: 3311 - DNA, 25 bp, Homo sapiens
tgccgcacgcagcagttcttctccg

SEQ ID NO: 3312 - DNA, 22 bp, Homo sapiens
cgcacgcagcagttcttctccg

SEQ ID NO: 3313 - DNA, 39 bp, Homo sapiens
gtagtgttccccactggtcccctgtgccttgatgccggg

SEQ ID NO: 3314 - DNA, 22 bp, Homo sapiens
tcccctgtgccttgatgccggg

SEQ ID NO: 3315 - DNA, 23 bp, Homo sapiens
gggcttggtggcaggcttgaggc

SEQ ID NO: 3316 - DNA, 25 bp, Homo sapiens
gaggcctgtgtttgggtcctgcggg

SEQ ID NO: 3317 - DNA, 23 bp, Homo sapiens
ggcctgtgtttgggtcctgcggg

SEQ ID NO: 3318 - DNA, 40 bp, Homo sapiens
acccctcacactccccatcctccctgctccgattccgagg

SEQ ID NO: 3319 - DNA, 22 bp, Homo sapiens
ctccccatcctccctgctccga

SEQ ID NO: 3320 - DNA, 22 bp, Homo sapiens
cctccctgctccgattccgagg

SEQ ID NO: 3321 - DNA, 32 bp, Homo sapiens
gctgaggaacaagcaccgcctggagccctggg

SEQ ID NO: 3322 - DNA, 22 bp, Homo sapiens
aagcaccgcctggagccctggg

SEQ ID NO: 3323 - DNA, 24 bp, Homo sapiens
ggctgaggaacaagcaccgcctgg

SEQ ID NO: 3324 - DNA, 31 bp, Homo sapiens
gtactaaccctacccccaaacccaaacccag

SEQ ID NO: 3325 - DNA, 22 bp, Homo sapiens
ccctacccccaaacccaaaccc

SEQ ID NO: 3326 - DNA, 41 bp, Homo sapiens
ttggtctggtaggagacggcgatgcggctgatggtgtgggt

SEQ ID NO: 3327 - DNA, 22 bp, Homo sapiens
cggcgatgcggctgatggtgtg

SEQ ID NO: 3328 - DNA, 22 bp, Homo sapiens
tggtaggagacggcgatgcggc

SEQ ID NO: 3329 - DNA, 22 bp, Homo sapiens
gggaggcgtttgggaaggttgg

SEQ ID NO: 3330 - DNA, 22 bp, Homo sapiens
ggagtgaaatcacccggaattc

SEQ ID NO: 3331 - DNA, 51 bp, Homo sapiens
tgtgtaggaccctggaggctgaaccccgtccccatgcccctcaaaacctat

SEQ ID NO: 3332 - DNA, 22 bp, Homo sapiens
ccccgtccccatgcccctcaaa

SEQ ID NO: 3333 - DNA, 24 bp, Homo sapiens
ccctggaggctgaaccccgtcccc

SEQ ID NO: 3334 - DNA, 38 bp, Homo sapiens
gctcatctggaggaagcggtagtgggccctgcaccttc

SEQ ID NO: 3335 - DNA, 22 bp, Homo sapiens
ggaagcggtagtgggccctgca

SEQ ID NO: 3336 - DNA, 30 bp, Homo sapiens
cctcctcggccagctccacgtcccggatca

SEQ ID NO: 3337 - DNA, 23 bp, Homo sapiens
ggccagctccacgtcccggatca

SEQ ID NO: 3338 - DNA, 24 bp, Homo sapiens
cctcctcggccagctccacgtccc

SEQ ID NO: 3339 - DNA, 36 bp, Homo sapiens
gccctcgagctctgcccaccccacatccggttcctg

SEQ ID NO: 3340 - DNA, 22 bp, Homo sapiens
tgcccaccccacatccggttcc

SEQ ID NO: 3341 - DNA, 22 bp, Homo sapiens
gccctcgagctctgcccacccc

SEQ ID NO: 3342 - DNA, 22 bp, Homo sapiens
ggcattggcccggcggttcagc

SEQ ID NO: 3343 - DNA, 22 bp, Homo sapiens
gggaatcgtgggctgggagggc

SEQ ID NO: 3344 - DNA, 52 bp, Homo sapiens
tttatagaggaagcggcagtggcagcgtggcaggcagcgggcgggttctagg

SEQ ID NO: 3345 - DNA, 21 bp, Homo sapiens
cagcgtggcaggcagcgggcg

SEQ ID NO: 3346 - DNA, 22 bp, Homo sapiens
cggcagtggcagcgtggcaggc

SEQ ID NO: 3347 - DNA, 23 bp, Homo sapiens
gaggaagcggcagtggcagcgtg

SEQ ID NO: 3348 - DNA, 45 bp, Homo sapiens
gggcggtagtccaaagcacgaagcacgggcagcccaaggagatgg

SEQ ID NO: 3349 - DNA, 23 bp, Homo sapiens
gcacgggcagcccaaggagatgg

SEQ ID NO: 3350 - DNA, 22 bp, Homo sapiens
gcacgaagcacgggcagcccaa

SEQ ID NO: 3351 - DNA, 35 bp, Homo sapiens
ggagacagcaccccccgacccccgagagagagatc

SEQ ID NO: 3352 - DNA, 25 bp, Homo sapiens
ccccccgacccccgagagagagatc

SEQ ID NO: 3353 - DNA, 22 bp, Homo sapiens
cagcaccccccgacccccgaga

SEQ ID NO: 3354 - DNA, 38 bp, Homo sapiens
ctgagccaccccagcagcccccattctcctgctgcctc

SEQ ID NO: 3355 - DNA, 22 bp, Homo sapiens
gcccccattctcctgctgcctc

SEQ ID NO: 3356 - DNA, 22 bp, Homo sapiens
tgagccaccccagcagccccca

SEQ ID NO: 3357 - DNA, 23 bp, Homo sapiens
ccccagcagcccccattctcctg

SEQ ID NO: 3358 - DNA, 38 bp, Homo sapiens
ggtgtgagctggaggcccggttccctgaagagcaatca

SEQ ID NO: 3359 - DNA, 25 bp, Homo sapiens
ggcccggttccctgaagagcaatca

SEQ ID NO: 3360 - DNA, 22 bp, Homo sapiens
gctggaggcccggttccctgaa

SEQ ID NO: 3361 - DNA, 46 bp, Homo sapiens
ggagagcctcacctgctgtgcggagcccctgggcccggacgctcag

SEQ ID NO: 3362 - DNA, 22 bp, Homo sapiens
gcccctgggcccggacgctcag

SEQ ID NO: 3363 - DNA, 22 bp, Homo sapiens
tgctgtgcggagcccctgggcc

SEQ ID NO: 3364 - DNA, 32 bp, Homo sapiens
ccaggcagagggcaggacactgctgggcggta

SEQ ID NO: 3365 - DNA, 22 bp, Homo sapiens
agggcaggacactgctgggcgg

SEQ ID NO: 3366 - DNA, 22 bp, Homo sapiens
ccaggcagagggcaggacactg

SEQ ID NO: 3367 - DNA, 36 bp, Homo sapiens
gggatccaggcagcaggtgcaggagggaccgaggcc

SEQ ID NO: 3368 - DNA, 22 bp, Homo sapiens
aggtgcaggagggaccgaggcc

SEQ ID NO: 3369 - DNA, 22 bp, Homo sapiens
ccaggcagcaggtgcaggaggg

SEQ ID NO: 3370 - DNA, 38 bp, Homo sapiens
ggaaaccaaaaccaaacccaccaaggcccaggcccagg

SEQ ID NO: 3371 - DNA, 22 bp, Homo sapiens
cccaccaaggcccaggcccagg

SEQ ID NO: 3372 - DNA, 23 bp, Homo sapiens
ccaaacccaccaaggcccaggcc

SEQ ID NO: 3373 - DNA, 27 bp, Homo sapiens
gggcacgcggcggaagacagacctccc

SEQ ID NO: 3374 - DNA, 23 bp, Homo sapiens
gggcacgcggcggaagacagacc

SEQ ID NO: 3375 - DNA, 44 bp, Homo sapiens
tgatgaggacaagggcagagaggcaggcgaaggcagggacatcg

SEQ ID NO: 3376 - DNA, 22 bp, Homo sapiens
gggcagagaggcaggcgaaggc

SEQ ID NO: 3377 - DNA, 34 bp, Homo sapiens
ggcccatcccttcctcccagccccgctcccacct

SEQ ID NO: 3378 - DNA, 22 bp, Homo sapiens
tcctcccagccccgctcccacc

SEQ ID NO: 3379 - DNA, 23 bp, Homo sapiens
ccatcccttcctcccagccccgc

SEQ ID NO: 3380 - DNA, 36 bp, Homo sapiens
tcccgaagttcttctgtgcactcccccaagtttccg

SEQ ID NO: 3381 - DNA, 22 bp, Homo sapiens
tgtgcactcccccaagtttccg

SEQ ID NO: 3382 - DNA, 59 bp, Homo sapiens
ggactggcgccccgagtctcagcctggtccctggtcccgcgtgcgctcccgaagttctt

SEQ ID NO: 3383 - DNA, 22 bp, Homo sapiens
cctggtcccgcgtgcgctcccg

SEQ ID NO: 3384 - DNA, 22 bp, Homo sapiens
cagcctggtccctggtcccgcg

SEQ ID NO: 3385 - DNA, 23 bp, Homo sapiens
ggactggcgccccgagtctcagc

SEQ ID NO: 3386 - DNA, 24 bp, Homo sapiens
gccgcgtcccgctgcccctgcccg

SEQ ID NO: 3387 - DNA, 34 bp, Homo sapiens
gggcggctggaagctgggcgtggagggcgacggg

SEQ ID NO: 3388 - DNA, 22 bp, Homo sapiens
gctgggcgtggagggcgacggg

SEQ ID NO: 3389 - DNA, 22 bp, Homo sapiens
ggcggctggaagctgggcgtgg

SEQ ID NO: 3390 - DNA, 24 bp, Homo sapiens
ccgctccgggccttggttgaggtc

SEQ ID NO: 3391 - DNA, 22 bp, Homo sapiens
ccgctccgggccttggttgagg

SEQ ID NO: 3392 - DNA, 56 bp, Homo sapiens
cggttctgcagctcctccacccgccgcggctcctgcagcccatgccggtcggtgat

SEQ ID NO: 3393 - DNA, 23 bp, Homo sapiens
cctgcagcccatgccggtcggtg

SEQ ID NO: 3394 - DNA, 22 bp, Homo sapiens
ctcctccacccgccgcggctcc

SEQ ID NO: 3395 - DNA, 22 bp, Homo sapiens
tctgcagctcctccacccgccg

SEQ ID NO: 3396 - DNA, 27 bp, Homo sapiens
gctcgcccgccacagctgccacgtgct

SEQ ID NO: 3397 - DNA, 22 bp, Homo sapiens
tcgcccgccacagctgccacgt

SEQ ID NO: 3398 - DNA, 34 bp, Homo sapiens
ttgaggtagaagatgcgctgcaggccctgggtgc

SEQ ID NO: 3399 - DNA, 23 bp, Homo sapiens
gatgcgctgcaggccctgggtgc

SEQ ID NO: 3400 - DNA, 37 bp, Homo sapiens
gggcagcgggcgagagacgagacgccgaggtgggagc

SEQ ID NO: 3401 - DNA, 24 bp, Homo sapiens
gagacgagacgccgaggtgggagc

SEQ ID NO: 3402 - DNA, 18 bp, Homo sapiens
ggcagcgggcgagagacg

SEQ ID NO: 3403 - DNA, 22 bp, Homo sapiens
gggcagcgggcgagagacgaga

SEQ ID NO: 3404 - DNA, 23 bp, Homo sapiens
cggtgtcggcggatggcgggagc

SEQ ID NO: 3405 - DNA, 34 bp, Homo sapiens
ccaaagcggcctcgaagcgggtcccgtgtctgcg

SEQ ID NO: 3406 - DNA, 22 bp, Homo sapiens
cgaagcgggtcccgtgtctgcg

SEQ ID NO: 3407 - DNA, 22 bp, Homo sapiens
aagcggcctcgaagcgggtccc

SEQ ID NO: 3408 - DNA, 23 bp, Homo sapiens
gggatccggaggcgtccactgcg

SEQ ID NO: 3409 - DNA, 22 bp, Homo sapiens
gggatccggaggcgtccactgc

SEQ ID NO: 3410 - DNA, 40 bp, Homo sapiens
caactgacagccccatagtgacggccggaggctttgtcgc

SEQ ID NO: 3411 - DNA, 22 bp, Homo sapiens
tgacggccggaggctttgtcgc

SEQ ID NO: 3412 - DNA, 54 bp, Homo sapiens
gcacactgggccaggccgagggtgaagagctcattccagcaggcccgcacaagg

SEQ ID NO: 3413 - DNA, 23 bp, Homo sapiens
gctcattccagcaggcccgcaca

SEQ ID NO: 3414 - DNA, 23 bp, Homo sapiens
gggccaggccgagggtgaagagc

SEQ ID NO: 3415 - DNA, 22 bp, Homo sapiens
gcacactgggccaggccgaggg

SEQ ID NO: 3416 - DNA, 38 bp, Homo sapiens
ctgagtgccggcaggcgaacgaggatccgggccaatcg

SEQ ID NO: 3417 - DNA, 22 bp, Homo sapiens
ggcgaacgaggatccgggccaa

SEQ ID NO: 3418 - DNA, 23 bp, Homo sapiens
gccggcaggcgaacgaggatccg

SEQ ID NO: 3419 - DNA, 40 bp, Homo sapiens
ctttagcagctcgttgtatttcctggtcaacctctcagcg

SEQ ID NO: 3420 - DNA, 22 bp, Homo sapiens
ggtttgccagccgggacaccca

SEQ ID NO: 3421 - DNA, 22 bp, Homo sapiens
tgcgtgaggtttgccagccggg

SEQ ID NO: 3422 - DNA, 38 bp, Homo sapiens
tacttattttccatcccccctgcctgccccccatagca

SEQ ID NO: 3423 - DNA, 25 bp, Homo sapiens
ttccatcccccctgcctgcccccca

SEQ ID NO: 3424 - DNA, 39 bp, Homo sapiens; identical to SEQ ID NO: 3193

SEQ ID NO: 3425 - DNA, 22 bp, Homo sapiens
tcccgccgcagcttagcctggg

SEQ ID NO: 3426 - DNA, 22 bp, Homo sapiens
ttcgtcgagctcccgccgcagc

SEQ ID NO: 3427 - DNA, 47 bp, Homo sapiens
gctttgttcttgggctctggctccgggcggagtcgttcccaccaggc

SEQ ID NO: 3428 - DNA, 22 bp, Homo sapiens
ggcggagtcgttcccaccaggc

SEQ ID NO: 3429 - DNA, 22 bp, Homo sapiens
ttgggctctggctccgggcgga

SEQ ID NO: 3430 - DNA, 23 bp, Homo sapiens
gggagaggctgggcggagttggg

SEQ ID NO: 3431 - DNA, 27 bp, Homo sapiens
gggaatggatccgttgacctgcaggtc

SEQ ID NO: 3432 - DNA, 22 bp, Homo sapiens
gggaatggatccgttgacctgc

SEQ ID NO: 3433 - DNA, 22 bp, Homo sapiens
gggcaatgggtggacagggcgg

SEQ ID NO: 3434 - DNA, 21 bp, Homo sapiens
gggcaatgggtggacagggcg

SEQ ID NO: 3435 - DNA, 37 bp, Homo sapiens
agggagaatctcctgtcgcagccacccctccccctgg

SEQ ID NO: 3436 - DNA, 22 bp, Homo sapiens
tcgcagccacccctccccctgg

SEQ ID NO: 3437 - DNA, 32 bp, Homo sapiens
gctgccatcccctgcccgcccatccgtcctgg

SEQ ID NO: 3438 - DNA, 22 bp, Homo sapiens
tcccctgcccgcccatccgtcc

SEQ ID NO: 3439 - DNA, 42 bp, Homo sapiens
ctccggcacctcccctccctggcttcctgggctccgtcgaaa

SEQ ID NO: 3440 - DNA, 22 bp, Homo sapiens
cctggcttcctgggctccgtcg

SEQ ID NO: 3441 - DNA, 22 bp, Homo sapiens
tccggcacctcccctccctggc

SEQ ID NO: 3442 - DNA, 37 bp, Homo sapiens
gttgcgtgaagctcgtgctcatcaggcggcggttgcg

SEQ ID NO: 3443 - DNA, 22 bp, Homo sapiens
tgctcatcaggcggcggttgcg

SEQ ID NO: 3444 - DNA, 35 bp, Homo sapiens
ggatgagagcccagccctcccagccccatgtccag

SEQ ID NO: 3445 - DNA, 22 bp, Homo sapiens
gcccagccctcccagccccatg

SEQ ID NO: 3446 - DNA, 23 bp, Homo sapiens
gccctccacactgcccatcccct

SEQ ID NO: 3447 - DNA, 38 bp, Homo sapiens
cagcctgctnngtcccgcccactccgccctgcagcagc

SEQ ID NO: 3448 - DNA, 22 bp, Homo sapiens
ccgcccactccgccctgcagca

SEQ ID NO: 3449 - DNA, 33 bp, Homo sapiens
ctgcccactctcccaggtcagcagcagccccac

SEQ ID NO: 3450 - DNA, 22 bp, Homo sapiens
tcccaggtcagcagcagcccca

SEQ ID NO: 3451 - DNA, 43 bp, Homo sapiens
gtttacgtaatgctccagccccccgccgtgcccacttcgcaga

SEQ ID NO: 3452 - DNA, 23 bp, Homo sapiens
gccccccgccgtgcccacttcgc

SEQ ID NO: 3453 - DNA, 22 bp, Homo sapiens
tgctccagccccccgccgtgcc

SEQ ID NO: 3454 - DNA, 41 bp, Homo sapiens
cctccagtgggatggtcaaggcagggaggcggtagcggctc

SEQ ID NO: 3455 - DNA, 22 bp, Homo sapiens
ggcagggaggcggtagcggctc

SEQ ID NO: 3456 - DNA, 23 bp, Homo sapiens
gggatggtcaaggcagggaggcg

SEQ ID NO: 3457 - DNA, 37 bp, Homo sapiens
ggcaccgcgcagtgaccccctccctcccctccagtgg

SEQ ID NO: 3458 - DNA, 22 bp, Homo sapiens
ccccctccctcccctccagtgg

SEQ ID NO: 3459 - DNA, 22 bp, Homo sapiens
ggcaccgcgcagtgaccccctc

SEQ ID NO: 3460 - DNA, 30 bp, Homo sapiens
gcccctgccgccaccccacccagagcctgc

SEQ ID NO: 3461 - DNA, 22 bp, Homo sapiens
tgccgccaccccacccagagcc

SEQ ID NO: 3462 - DNA, 22 bp, Homo sapiens
gcccctgccgccaccccaccca

SEQ ID NO: 3463 - DNA, 28 bp, Homo sapiens
aagcttcccctcattcgcccacctggaa

SEQ ID NO: 3464 - DNA, 22 bp, Homo sapiens
tcccctcattcgcccacctgga

SEQ ID NO: 3465 - DNA, 29 bp, Homo sapiens
aggagagaccctgaggtgcggcgctggcg

SEQ ID NO: 3466 - DNA, 22 bp, Homo sapiens
accctgaggtgcggcgctggcg

SEQ ID NO: 3467 - DNA, 28 bp, Homo sapiens
gcggttgcgcggcccctggctcagctgc

SEQ ID NO: 3468 - DNA, 22 bp, Homo sapiens
ttgcgcggcccctggctcagct

SEQ ID NO: 3469 - DNA, 47 bp, Homo sapiens
gaaacccctccccctgcactccacccccaccatgcccctcccaagaa

SEQ ID NO: 3470 - DNA, 22 bp, Homo sapiens
ccacccccaccatgcccctccc

SEQ ID NO: 3471 - DNA, 22 bp, Homo sapiens
ccccctgcactccacccccacc

SEQ ID NO: 3472 - DNA, 26 bp, Homo sapiens
gtgtccccttttcacctggcggccaa

SEQ ID NO: 3473 - DNA, 23 bp, Homo sapiens
tccccttttcacctggcggccaa

SEQ ID NO: 3474 - DNA, 26 bp, Homo sapiens
ggaccagcccccagcaccccatctgt

SEQ ID NO: 3475 - DNA, 22 bp, Homo sapiens
ggaccagcccccagcaccccat

SEQ ID NO: 3476 - DNA, 33 bp, Homo sapiens
catcaagctgcggacgatgcgggacttgggaaa

SEQ ID NO: 3477 - DNA, 22 bp, Homo sapiens
tgcggacgatgcgggacttggg

SEQ ID NO: 3478 - DNA, 33 bp, Homo sapiens
tcgtatgaattctgttggcgggtgctggaaggc

SEQ ID NO: 3479 - DNA, 22 bp, Homo sapiens
ctgttggcgggtgctggaaggc

SEQ ID NO: 3480 - DNA, 25 bp, Homo sapiens
ccacggctcctggctcccaccccct

SEQ ID NO: 3481 - DNA, 23 bp, Homo sapiens
cacggctcctggctcccaccccc

SEQ ID NO: 3482 - DNA, 39 bp, Homo sapiens
gtctatgatgctggacgcgcggctgaagtggtcctgcat

SEQ ID NO: 3483 - DNA, 22 bp, Homo sapiens
gctggacgcgcggctgaagtgg

SEQ ID NO: 3484 - DNA, 53 bp, Homo sapiens
cagctgtactccccgatgtggtaccccctgccccatctcccactgccgtgctg

SEQ ID NO: 3485 - DNA, 22 bp, Homo sapiens
gccccatctcccactgccgtgc

SEQ ID NO: 3486 - DNA, 25 bp, Homo sapiens
tccccgatgtggtaccccctgcccc

SEQ ID NO: 3487 - DNA, 24 bp, Homo sapiens
gcccaaagcccctgaatccccata

SEQ ID NO: 3488 - DNA, 22 bp, Homo sapiens
gcccaaagcccctgaatcccca

SEQ ID NO: 3489 - DNA, 44 bp, Homo sapiens
tggatcaccctgtacatcacctggcccccattctcagttcggaa

SEQ ID NO: 3490 - DNA, 23 bp, Homo sapiens
cctggcccccattctcagttcgg

SEQ ID NO: 3491 - DNA, 23 bp, Homo sapiens
ccctgtacatcacctggccccca

SEQ ID NO: 3492 - DNA, 23 bp, Homo sapiens
gccatccagctgcccctcagaca

SEQ ID NO: 3493 - DNA, 27 bp, Homo sapiens
gtgaaagcaccctggatcaccgcctgg

SEQ ID NO: 3494 - DNA, 22 bp, Homo sapiens
agcaccctggatcaccgcctgg

SEQ ID NO: 3495 - DNA, 35 bp, Homo sapiens
gcagctgtactccccgatgtggtaccccctgcccc

SEQ ID NO: 3496 - DNA, 22 bp, Homo sapiens
cccgatgtggtaccccctgccc

SEQ ID NO: 3497 - DNA, 36 bp, Homo sapiens
ggtcgcctgccccagcagtgcctctgagccctgggt

SEQ ID NO: 3498 - DNA, 23 bp, Homo sapiens
gccccagcagtgcctctgagccc

SEQ ID NO: 3499 - DNA, 23 bp, Homo sapiens
ggtcgcctgccccagcagtgcct

SEQ ID NO: 3500 - DNA, 33 bp, Homo sapiens
gggcaattgagcgctggcttcctccctgcagta

SEQ ID NO: 3501 - DNA, 22 bp, Homo sapiens
tgagcgctggcttcctccctgc

SEQ ID NO: 3502 - DNA, 47 bp, Homo sapiens
tccagttgttgatcttgtctcggcggcgacgctccacttcattatgc

SEQ ID NO: 3503 - DNA, 24 bp, Homo sapiens
tctcggcggcgacgctccacttca

SEQ ID NO: 3504 - DNA, 46 bp, Homo sapiens
gatgacgacctctaatccgtggtgccgcaactgagctcgaagcagc

SEQ ID NO: 3505 - DNA, 22 bp, Homo sapiens
cgtggtgccgcaactgagctcg

SEQ ID NO: 3506 - DNA, 41 bp, Homo sapiens
attgtgtgcttcacaccactgcaggccgccatatcacaggg

SEQ ID NO: 3507 - DNA, 22 bp, Homo sapiens
ttcacaccactgcaggccgcca

SEQ ID NO: 3508 - DNA, 24 bp, Homo sapiens
gcgagaggagcacaaggcccaggg

SEQ ID NO: 3509 - DNA, 46 bp, Homo sapiens
cagtcactccgtggccccaggcaccccccacccccataagccaact

SEQ ID NO: 3510 - DNA, 22 bp, Homo sapiens
ccgtggccccaggcacccccca

SEQ ID NO: 3511 - DNA, 22 bp, Homo sapiens
gcaccccccacccccataagcc

SEQ ID NO: 3512 - DNA, 31 bp, Homo sapiens
ggctcccacccaccccaaccctccctttcca

SEQ ID NO: 3513 - DNA, 22 bp, Homo sapiens
tcccacccaccccaaccctccc

SEQ ID NO: 3514 - DNA, 41 bp, Homo sapiens
ctcacagcttctcccctatccttcccccagtcccctccctt

SEQ ID NO: 3515 - DNA, 22 bp, Homo sapiens
tccttcccccagtcccctccct

SEQ ID NO: 3516 - DNA, 35 bp, Homo sapiens
ggcccttgttcctgctgcccccccaaccccagatg

SEQ ID NO: 3517 - DNA, 22 bp, Homo sapiens
tcctgctgcccccccaacccca

SEQ ID NO: 3518 - DNA, 54 bp, Homo sapiens
ttggaatcctggagtgacccctggccttctccccgctccaacaccctcaacccc

SEQ ID NO: 3519 - DNA, 22 bp, Homo sapiens
ccgctccaacaccctcaacccc

SEQ ID NO: 3520 - DNA, 22 bp, Homo sapiens
cccctggccttctccccgctcc

SEQ ID NO: 3521 - DNA, 28 bp, Homo sapiens
gggcattggcgaggagggagcaggaaag

SEQ ID NO: 3522 - DNA, 22 bp, Homo sapiens
gggcattggcgaggagggagca

SEQ ID NO: 3523 - DNA, 24 bp, Homo sapiens
gcccgcagcccgccgcaatgaagg

SEQ ID NO: 3524 - DNA, 22 bp, Homo sapiens
gcccgcagcccgccgcaatgaa

SEQ ID NO: 3525 - DNA, 38 bp, Homo sapiens
aggtcactcactttgcccctgtcgctttcgctgctcgc

SEQ ID NO: 3526 - DNA, 22 bp, Homo sapiens
ttgcccctgtcgctttcgctgc

SEQ ID NO: 3527 - DNA, 38 bp, Homo sapiens
cgacgccgcgagccccgaccccctccaccccgcctccg

SEQ ID NO: 3528 - DNA, 23 bp, Homo sapiens
gacgccgcgagccccgaccccct

SEQ ID NO: 3529 - DNA, 28 bp, Homo sapiens
cgcacaccgccgcctcacccgtccatga

SEQ ID NO: 3530 - DNA, 22 bp, Homo sapiens
cgcacaccgccgcctcacccgt

SEQ ID NO: 3531 - DNA, 21 bp, Homo sapiens
gggagtgagggcacagaattc

SEQ ID NO: 3532 - DNA, 31 bp, Homo sapiens
gctcattctggccccctcccttgcatccctt

SEQ ID NO: 3533 - DNA, 22 bp, Homo sapiens
tggccccctcccttgcatccct

SEQ ID NO: 3534 - DNA, 42 bp, Homo sapiens
cacatcttccctaagtgctcccaaaggcccccatcccattct

SEQ ID NO: 3535 - DNA, 22 bp, Homo sapiens
gctcccaaaggcccccatccca

SEQ ID NO: 3536 - DNA, 28 bp, Homo sapiens
gaaactctgtccagagacacgcgcccgc

SEQ ID NO: 3537 - DNA, 22 bp, Homo sapiens
ctgtccagagacacgcgcccgc

SEQ ID NO: 3538 - DNA, 41 bp, Homo sapiens
aatatcaaattccagcaccgagcgccctggccggtgagtcc

SEQ ID NO: 3539 - DNA, 23 bp, Homo sapiens
cgagcgccctggccggtgagtcc

SEQ ID NO: 3540 - DNA, 44 bp, Homo sapiens
ggaagtagagcaatctccccaagccgtcggcccgattcaagtgg

SEQ ID NO: 3541 - DNA, 22 bp, Homo sapiens
tctccccaagccgtcggcccga

SEQ ID NO: 3542 - DNA, 27 bp, Homo sapiens
gcccgcgcgctctctctgaccccgtct

SEQ ID NO: 3543 - DNA, 22 bp, Homo sapiens
cccgcgcgctctctctgacccc

SEQ ID NO: 3544 - DNA, 27 bp, Homo sapiens
gctccggcggtcacccccaaaagcagg

SEQ ID NO: 3545 - DNA, 22 bp, Homo sapiens
ccggcggtcacccccaaaagca

SEQ ID NO: 3546 - DNA, 41 bp, Homo sapiens
ctcttccttctcttcttcctcctccccctcctccggctgcg

SEQ ID NO: 3547 - DNA, 22 bp, Homo sapiens
tcctccccctcctccggctgcg

SEQ ID NO: 3548 - DNA, 25 bp, Homo sapiens
gcgcgcgcggctggagcactgtctg

SEQ ID NO: 3549 - DNA, 22 bp, Homo sapiens
gcgcgcggctggagcactgtct

SEQ ID NO: 3550 - DNA, 34 bp, Homo sapiens
cggctcgcgctccctctccggctcgggctgtggg

SEQ ID NO: 3551 - DNA, 22 bp, Homo sapiens
cctctccggctcgggctgtggg

SEQ ID NO: 3552 - DNA, 22 bp, Homo sapiens
tcgcgctccctctccggctcgg

SEQ ID NO: 3553 - DNA, 25 bp, Homo sapiens
gcagcagcccccgcatcgcatcagg

SEQ ID NO: 3554 - DNA, 22 bp, Homo sapiens
gcagcccccgcatcgcatcagg

SEQ ID NO: 3555 - DNA, 41 bp, Homo sapiens
gggcacacactccaggccctcgtcattgcagcagcccccgc

SEQ ID NO: 3556 - DNA, 22 bp, Homo sapiens
tcgtcattgcagcagcccccgc

SEQ ID NO: 3557 - DNA, 61 bp, Homo sapiens
caggacttataccgggatttcttgcgctttcgtttttgcccctttccctttcctcgaactg

SEQ ID NO: 3558 - DNA, 22 bp, Homo sapiens
tttgcccctttccctttcctcg

SEQ ID NO: 3559 - DNA, 22 bp, Homo sapiens
accgggatttcttgcgctttcg

SEQ ID NO: 3560 - DNA, 27 bp, Homo sapiens
agcgggcaccaacgtacacgctccagg

SEQ ID NO: 3561 - DNA, 22 bp, Homo sapiens
cgggcaccaacgtacacgctcc

SEQ ID NO: 3562 - DNA, 60 bp, Homo sapiens
tcttgtacaaacaaatgctttctccgctctgagcaaggcccacagggactgcaaaaaggc

SEQ ID NO: 3563 - DNA, 23 bp, Homo sapiens
ccgctctgagcaaggcccacagg

SEQ ID NO: 3564 - DNA, 24 bp, Homo sapiens
gccgcctgcctcctcccaactcat

SEQ ID NO: 3565 - DNA, 22 bp, Homo sapiens
gccgcctgcctcctcccaactc

SEQ ID NO: 3566 - DNA, 36 bp, Homo sapiens
agaaatctgtcatgctggtctgccgccgttttcgac

SEQ ID NO: 3567 - DNA, 22 bp, Homo sapiens
tgctggtctgccgccgttttcg

SEQ ID NO: 3568 - DNA, 41 bp, Homo sapiens
ggtctgctccagtaccccaccttccccctgccttcacaaga

SEQ ID NO: 3569 - DNA, 22 bp, Homo sapiens
ccccaccttccccctgccttca

SEQ ID NO: 3570 - DNA, 26 bp, Homo sapiens
agctgctcgctgtccactgggccgaa

SEQ ID NO: 3571 - DNA, 22 bp, Homo sapiens
tgctcgctgtccactgggccga

SEQ ID NO: 3572 - DNA, 45 bp, Homo sapiens
aagttccatcgctcacgggcctcctggatgcagcccgccattagc

SEQ ID NO: 3573 - DNA, 22 bp, Homo sapiens
gcctcctggatgcagcccgcca

SEQ ID NO: 3574 - DNA, 22 bp, Homo sapiens
ccatcgctcacgggcctcctgg

SEQ ID NO: 3575 - DNA, 31 bp, Homo sapiens
gcaggccaaggccccgcacacgctcccaggc

SEQ ID NO: 3576 - DNA, 22 bp, Homo sapiens
ggccccgcacacgctcccaggc

SEQ ID NO: 3577 - DNA, 22 bp, Homo sapiens
gcaggccaaggccccgcacacg

SEQ ID NO: 3578 - DNA, 33 bp, Homo sapiens
gggagcggacaggcggtcgggttgcggagagcc

SEQ ID NO: 3579 - DNA, 22 bp, Homo sapiens
gcggacaggcggtcgggttgcg

SEQ ID NO: 3580 - DNA, 46 bp, Homo sapiens
gggtgggtgggtgaatgagtaggtgggagggagggcgggaagtggg

SEQ ID NO: 3581 - DNA, 22 bp, Homo sapiens
gggagggagggcgggaagtggg

SEQ ID NO: 3582 - DNA, 32 bp, Homo sapiens
ccggctctgggtgggtgggtgggtgaatgagt

SEQ ID NO: 3583 - DNA, 22 bp, Homo sapiens
ccggctctgggtgggtgggtgg

SEQ ID NO: 3584 - DNA, 28 bp, Homo sapiens
gcacagccgccgccgccacccagggagg

SEQ ID NO: 3585 - DNA, 22 bp, Homo sapiens
cagccgccgccgccacccaggg

SEQ ID NO: 3586 - DNA, 35 bp, Homo sapiens
cctgtttgatgaaggagtgaggcggcggcggcggg

SEQ ID NO: 3587 - DNA, 23 bp, Homo sapiens
gatgaaggagtgaggcggcggcg

SEQ ID NO: 3588 - DNA, 24 bp, Homo sapiens
ccgggtgtgggcgctgccttgaac

SEQ ID NO: 3589 - DNA, 40 bp, Homo sapiens
cgtgtgctgagacgccggctccgggacacacgtggaagcc

SEQ ID NO: 3590 - DNA, 22 bp, Homo sapiens
cgccggctccgggacacacgtg

SEQ ID NO: 3591 - DNA, 22 bp, Homo sapiens
tgctgagacgccggctccggga

SEQ ID NO: 3592 - DNA, 34 bp, Homo sapiens
gcacccaggcccggagcggagcgtgtgctgagac

SEQ ID NO: 3593 - DNA, 22 bp, Homo sapiens
cacccaggcccggagcggagcg

SEQ ID NO: 3594 - DNA, 22 bp, Homo sapiens
gcccggagcggagcgtgtgctg

SEQ ID NO: 3595 - DNA, 22 bp, Homo sapiens
gggcgcaaagtccagcaccggc

SEQ ID NO: 3596 - DNA, 24 bp, Homo sapiens
cctcggctcctcggctgcgggcgg

SEQ ID NO: 3597 - DNA, 22 bp, Homo sapiens
cctcggctcctcggctgcgggc

SEQ ID NO: 3598 - DNA, 43 bp, Homo sapiens
taactcttcttgccgctcttcttgccgccgcccttcttgacgc

SEQ ID NO: 3599 - DNA, 22 bp, Homo sapiens
gccgctcttcttgccgccgccc

SEQ ID NO: 3600 - DNA, 31 bp, Homo sapiens
gcgcgcagcccgtccgagtcgtcgccgccca

SEQ ID NO: 3601 - DNA, 22 bp, Homo sapiens
gcccgtccgagtcgtcgccgcc

What is claimed is:

1. A method for rational discovery of antisense oligonucleotides useful as therapeutics for the treatment of an Aberrant Programming Disease wherein said Aberrant Programming Disease is cancer, comprising the steps of (i) selecting one or more transcriptional regulator gene targets implicated in the regulation of cellular programming, said transcriptional regulator targets are not oncogenes and are expressed by cancer cells to be reprogrammed; (ii) selecting one or more prototype antisense oligonucleotides(s) to target transcripts of the selected non-oncogene transcriptional regulators, where said prototype antisense oligonucleotide(s) is selected from the group of oligonucleotides comprising SEQ ID NO: 1 through SEQ ID NO: 3626; (iii) evaluating said prototype antisense oligonucleotide(s) in a Reprogramming Test, alone and then in combination with an augmentation agent, for capacity to therapeutically reprogram the Aberrant Programmed disease cells while not adversely reprogramming normal cells, said augmentation agent being capable of altering the pattern of transcriptional regulator expression in the Aberrant Programmed disease cells; (iv) selecting sequence- and length-variants of prototype oligonucleotides scored in the Reprogramming Test to exhibit capacity to reprogram Aberrant Programming cells; (v) evaluating said variants for efficacy in the Reprogramming Test, either alone or in combination with the appropriate augmentation agent; (vi) selecting the most active of the evaluated antisense oligonucleotides, or antisense oligonucleotide/augmentation agent combination, and testing the same in vivo for efficacy.

2. The method of claim 1, wherein said augmentation agent is selected from the group consisting of a cytokine, a cancer chemotherapeutic agent, and a generator of free-radicals.

3. A method for discovering oligonucleotide therapeutics for the treatment of diseases dependent on an inappropriate expression or suppression of the physiological death program, apoptosis, that involves the steps of (i) selecting a target gene known to be directly involved in the regulation of apoptosis by determining if the gene is expressed by said disease and as appropriate where said gene target is thought to promote or inhibit apoptosis; (ii) contacting normal and disease cells with antisense oligonucleotides designed by a Tertiary Selection Method to identify those that are most therapeutically active on the diseased cells; (iii) testing variants of these most active antisense oligonucleotides for increased efficacy in treating the diseased cells; and (iv) testing the most active oligonucleotides for toxicity and in vivo efficacy.

4. A method for identifying oligonucleotide therapeutics for treatment of aberrant programming diseases or medical disorders caused by dysregulated apoptosis, said method comprising:
   a) selecting a target gene sequence which regulates cellular programming;
   b) determining that said target gene is present and expressed in aberrant programmed diseased cells;
   c) selecting at least one antisense molecule consisting essentially of a sequence selected from the group of prototype oligonucleotide sequences set forth in Table 19;
   d) incubating the aberrantly programmed diseased cells in the presence and absence of said at least one antisense molecule;
   e) identifying those antisense molecule(s) which affect apoptosis of said diseased cells relative to control untreated diseased cells;
   f) contacting normal cells with the antisense molecule(s) identified in step e) and
   g) identifying those antisense molecules which differentially affect apoptosis in aberrantly programmed cells versus normal cells.

5. A method as claimed in claim 4, wherein said medical disorder is selected from the group of disorders selected from the group consisting of cancer and prostatic hyperplasia.

6. A method as claimed in claim 4, wherein said disorder is Alzheimer's disease.

7. A method as claimed in claim 4, wherein said disease is cancer.

8. A method as claimed in claim 4, wherein viability of said cells is assessed by metabolic labeling.

9. The method as claimed in claim 4, further comprising the step of assessing the oligonucleotide therapeutic so identified for efficacy and toxicity in an in vivo animal model.

10. A method as claimed in claim 4, wherein said antisense molecule of step g) inhibits apoptosis.

11. A method as claimed in claim 4, wherein said antisense molecule of step g) promotes apoptosis.

12. A method for rational discovery of antisense oligonucleotides useful as therapeutics for the treatment of an Aberrant Programming Disease wherein said Aberrant Programming Disease is cancer, comprising the steps of (i) selecting one or more gene targets implicated in cancer; (ii) selecting one or more prototype antisense oligonucleotides(s) to target cancer related transcripts, where said prototype antisense oligonucleotide(s) is selected from the group of oligonucleotides comprising SEQ ID NO: 1 through SEQ ID NO: 3626; (iii) evaluating said prototype antisense oligonucleotide(s) for efficacy in inhibition of cancer cell growth while not affecting the growth of normal cells, alone and then in combination with an augmentation agent, (iv) selecting sequence- and length-variants of prototype oligonucleotides which inhibit the growth of cancer cells while not affecting normal cells, (v) evaluating said variants for efficacy in the cancer cell specific growth inhibition, either alone or in combination with the appropriate augmentation agent; (vi) selecting the most active of the evaluated antisense oligonucleotides, or antisense oligonucleotide/augmentation agent combination and testing the same in vivo for efficacy.

13. The method as claimed in claim 12, wherein said prototype oligonucleotides are selected from the group consisting of 5-alpha reductase (SEQ ID NOS: 7-45), epidermal growth factor receptor (SEQ ID NOS: 941-950), FLT-1 (SEQ ID NOS: 1146-1161) FLT-4 (SEQ ID NOS: 1162-1197), hgpX1 (SEQ ID: 1423-1468), KDR/FLK-1 (SEQ ID NOS: 2105-2125), MTS-1 (SEQ ID NOS: 2322-2340), MTS-2 (SEQ ID NOS: 2341-2361), p34cdc2 (SEQ ID NOS:2782-2805), Pim-1 (SEQ ID NOS: 2878-2909), PKC (SEQ ID NOS:2910-3045), Platelet derived endothelial growth factor (SEQ ID NOS:2816-2839), Platelet derived growth factor receptor (SEQ ID NOS:2840-2862), ref-1 (SEQ ID NOS: 3121-3142), TGFβ (SEQ ID NOS:3291-3314), and vascular endothelial growth factor (SEQ ID NOS: 3509-3563).

14. The method as claimed in claim 1, wherein said antisense oligonucleotides hybridize to a transcriptional regulator selected from the group consisting of: ets-1; ets-2; c-jun; jun-B; jun-D; id-1; id-2; id-3; Gadd-45; hox 1.3; mcl-1; nf kappa B; waf-1; Rb; p107; nf-atc; p53; and Rb-2.

15. The method as claimed in claim 3, wherein said antisense oligonucleotides are selected from the group consisting of those which hybridize to Bax-alpha (SEQ ID NOS: 239-253), BCL-X (SEQ ID NOS: 254-263, BCL-XL (SEQ ID NOS:264-278), BCL2-alpha (SEQ ID NOS:279-312, BCL-2 beta (SEQ ID NOS:313-317), Cyclin (SEQ ID NOS: 653-699), DAD-1 (SEQ ID NOS: 700-738), FAS/APO-1 (SEQ ID NOS: 1139-1145), ICE (SEQ ID NOS: 1919-1933), ICH-1L (SEQ ID NOS: 1934-1950), ICH-1S (SEQ ID NOS: 1951-1964), MCL-1 (SEQ ID NOS: 2231-2264), SGP2 (SEQ ID NOS: 3175-3197).

16. The method as claimed in claim 4, wherein said antisense oligonucleotides are selected from the group consisting of those which hybridize to Bax-alpha (SEQ ID NOS: 239-253), BCL-X (SEQ ID NOS: 254-263), BCL-XL (SEQ ID NOS:264-278), BCL2-alpha (SEQ ID NOS:279-312, BCL-2 beta (SEQ ID NOS:313-317), Cyclin (SEQ ID NOS: 653-699), DAD-1 (SEQ ID NOS: 700-738), FAS/APO-1 (SEQ ID NOS: 1139-1145), ICE (SEQ ID NOS: 1919-1933), ICH-1L (SEQ ID NOS: 1934-1950), ICH-1S (SEQ ID NOS: 1951-1964), MCL-1 (SEQ ID NOS: 2231-2264), SGP2 (SEQ ID NOS: 3175-3197).

17. A method as claimed in claim 12, wherein said gene target implicated in the development of cancer is selected from the group consisting of BCL-XL, cdk-2, cdk-4 inhibitor, erk, BCL2-alpha, BCL-2 beta, and TNF-alpha.

* * * * *